(12) United States Patent
Hilbert et al.

(10) Patent No.: US 11,730,763 B2
(45) Date of Patent: Aug. 22, 2023

(54) MULTIFUNCTIONAL IMMUNE CELL THERAPIES

(71) Applicant: ARCELLX, INC, Germantown, MD (US)

(72) Inventors: David M. Hilbert, Germantown, MD (US); Jeffrey S. Swers, Germantown, MD (US); David William Lafleur, Washington, DC (US)

(73) Assignee: Arcellx, Inc., Germantown, MD (US)

( * ) Notice: Subject to any disclaimer, the term of this patent is extended or adjusted under 35 U.S.C. 154(b) by 557 days.

(21) Appl. No.: 16/763,776

(22) PCT Filed: Nov. 14, 2018

(86) PCT No.: PCT/US2018/060902
§ 371 (c)(1),
(2) Date: May 13, 2020

(87) PCT Pub. No.: WO2019/099440
PCT Pub. Date: May 23, 2019

(65) Prior Publication Data
US 2021/0023133 A1   Jan. 28, 2021

Related U.S. Application Data

(60) Provisional application No. 62/717,165, filed on Aug. 10, 2018, provisional application No. 62/585,770, filed on Nov. 14, 2017.

(51) Int. Cl.
*A61K 35/17* (2015.01)
*A61P 35/00* (2006.01)
(Continued)

(52) U.S. Cl.
CPC .......... *A61K 35/17* (2013.01); *A61K 38/1774* (2013.01); *A61P 35/00* (2018.01);
(Continued)

(58) Field of Classification Search
None
See application file for complete search history.

(56) References Cited

U.S. PATENT DOCUMENTS 6,534,628 B1   3/2003   Nilsson et al.
7,314,974 B2   1/2008   Cao et al.
(Continued)

FOREIGN PATENT DOCUMENTS

CN   107254447 A   10/2017
EP   3025719 A1   6/2016
(Continued)

OTHER PUBLICATIONS

K. Tamada et al., "Redirecting Gene-Modified T Cells Toward Various Cancer Types Using Tagged Antibodies", Clinical Cancer Research, vol. 18, No. 23, Oct. 2, 2012, pp. 6436-6445, XP055154500.
(Continued)

*Primary Examiner* — Karl J Puttlitz
(74) *Attorney, Agent, or Firm* — Nixon & Vanderhye P.C.

(57) ABSTRACT

Provided herein are multi-functional chimeric antigen receptor (CAR)-based compositions and their use in directing immune responses to target cells. The compositions have uses that include treating hyperproliferative disorders such as cancer. The provided methods generally include the use of a CAR cell in combination with an Adapter. The Adapter confers the ability to modulate, alter, and/or redirect CAR cell-mediated immune response in vitro and in vivo. In some embodiments, the CAR cell comprises a genetic modification to reduce or eliminate the expression of a targeted antigenic determinant.

Figure 1A:
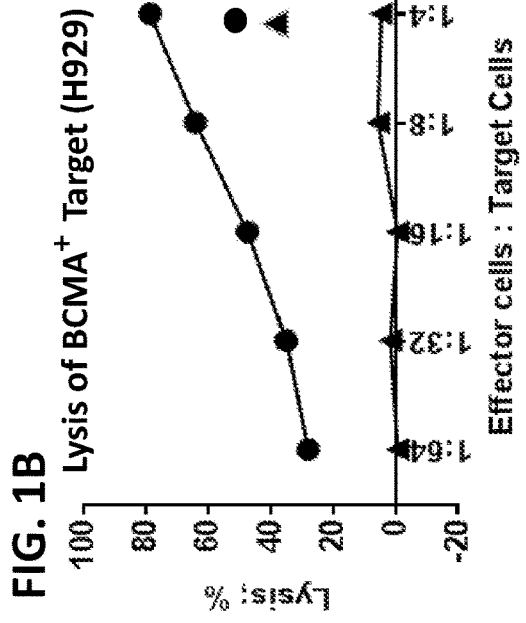
Figure 1B:
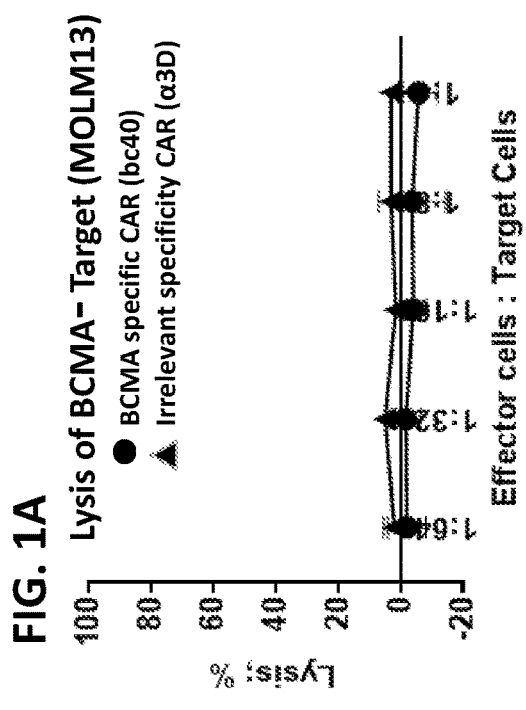
Figure 1C:
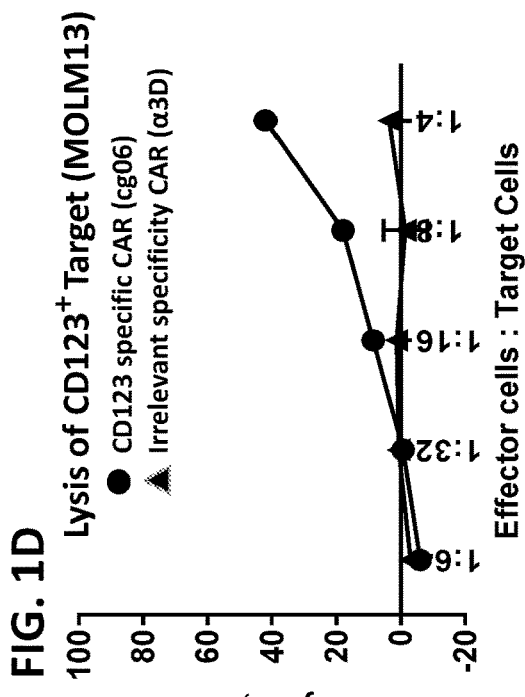

68 Claims, 17 Drawing Sheets
Specification includes a Sequence Listing.

(51) Int. Cl.
  *A61K 38/17* (2006.01)
  *C07K 14/725* (2006.01)
  *C07K 16/28* (2006.01)
  *C07K 16/32* (2006.01)
(52) U.S. Cl.
  CPC ........ *C07K 14/7051* (2013.01); *C07K 16/289* (2013.01); *C07K 16/2866* (2013.01); *C07K 16/2878* (2013.01); *C07K 16/32* (2013.01); *C07K 2317/622* (2013.01); *C07K 2317/73* (2013.01); *C07K 2317/92* (2013.01); *C07K 2319/33* (2013.01)

(56) References Cited

U.S. PATENT DOCUMENTS

| | | |
|---|---|---|
| 8,268,756 B2 | 9/2012 | Logtenberg et al. |
| 9,045,545 B1 | 6/2015 | Clube |
| 9,902,758 B2 | 2/2018 | Shin et al. |
| 10,647,775 B2 | 5/2020 | Lafleur et al. |
| 10,662,248 B2 | 5/2020 | Lafleur et al. |
| 11,008,397 B2 | 5/2021 | Lafleur et al. |
| 2012/0195882 A1 | 8/2012 | Doms et al. |
| 2013/0158232 A1 | 6/2013 | Timmerman et al. |
| 2013/0190221 A1 | 7/2013 | Burrows et al. |
| 2014/0271582 A1 | 9/2014 | Forman et al. |
| 2016/0311878 A1 | 10/2016 | Shin et al. |
| 2018/0209983 A1 | 7/2018 | Lafleur et al. |
| 2018/0251521 A1 | 9/2018 | Lafleur et al. |
| 2018/0251563 A1 | 9/2018 | Lafleur et al. |
| 2020/0223934 A1 | 7/2020 | Lafleur et al. |
| 2020/0362046 A1 | 11/2020 | Lafleur et al. |
| 2021/0002381 A1 | 1/2021 | Lafleur et al. |
| 2021/0230288 A1 | 7/2021 | Lafleur et al. |
| 2021/0401891 A1 | 12/2021 | Hilbert et al. |
| 2021/0403517 A1 | 12/2021 | Hilbert et al. |

FOREIGN PATENT DOCUMENTS

| | | |
|---|---|---|
| WO | 2005024044 A2 | 3/2005 |
| WO | WO 2007019376 | 2/2007 |
| WO | 2008052043 | 5/2008 |
| WO | WO 2010124829 | 11/2010 |
| WO | 2011034947 A2 | 3/2011 |
| WO | 2012167109 A1 | 6/2012 |
| WO | WO 2014138805 | 9/2014 |
| WO | 2014167350 | 10/2014 |
| WO | 2015168666 A1 | 11/2015 |
| WO | WO 20160154621 | 9/2016 |
| WO | WO 2016164305 | 10/2016 |
| WO | WO 2016164308 | 10/2016 |
| WO | WO 2016164369 | 10/2016 |
| WO | 2017083511 | 5/2017 |
| WO | 2018083071 A1 | 5/2018 |
| WO | WO2019099433 | 5/2019 |
| WO | WO 2019099440 | 5/2019 |
| WO | 2022204340 A1 | 9/2022 |

OTHER PUBLICATIONS

Michael C. Gundry et al., "Highly Efficient Genome Editing of Murine and Human Hematopoietic Progenitor Cells by CRISPR/Cas9", Cell Reports, vol. 17, No. 5, Oct. 25, 2016, pp. 1453-1461, XP055485683.
Zhao et al., "11A Herceptin-Based Chimeric Antigen Receptor with Modified Signaling Domains Leads to Enhanced Survival of Transduced T Lymphocytes and Antitumor Activity," The Journal of Immunology, 183(9): 5563-5574 (2009).
Qin et al., "Chimeric Antigen Receptors Incorporating D Domains Targeting CD123 Direct Potent Mono- and Bi-specific Antitumor Activity of T Cells" Molecular Therapy vol. 27. No. 7 pp. 1262-1274, Jul. 2019.
Carpenter R.O. et al., B-cell maturation antigen is a promising target for adoptive T-cell therapy of multiple myeloma. Clin Cancer Res, Jan. 23, 2013, vol. 19, No. 8, pp. 2048-2060.
U.S. Appl. No. 15/564,319, filed Oct. 4, 2017, U.S. Pat. No. 10,647,775, May 12, 2020.
U.S. Appl. No. 15/564,325, filed Oct. 4, 2017, U.S. Pat. No. 10,662,248, May 26, 2020.
U.S. Appl. No. 15/564,430, filed Oct. 5, 2017, US 20180209983, Jul. 26, 2018.
U.S. Appl. No. 16/817,755, filed Mar. 13, 2020, US 20200223934, Jul. 16, 2020.
U.S. Appl. No. 16/751,730, filed Jan. 24, 2020, unpublished.
U.S. Appl. No. 16/824,809, filed Mar. 20, 2020, unpublished.
U.S. Appl. No. 16/763,776, filed May 13, 2020, unpublished.
U.S. Appl. No. 16/763,784, filed May 13, 2020, unpublished.
Unpublished U.S. Appl. No. 18/055,096, filed Nov. 14, 2022, inventor: Swers et al.
Unpublished U.S. Appl. No. 17/936,023, filed Sep. 28, 2022, inventor: Hilbert et al.
Unpublished U.S. Appl. No. 18/145,169, filed Dec. 22, 2022, inventor: Lafleur, David William.
Ali et al., Blood 128(13): 1688-1700 (2016).
Lonial et al., N Erigl J Med 373:621-31 (2015).
Frankel AE et al., "Characterization of diphtheria fusion proteins targeted to the human interleukin-3 receptor" Protein Eng. 13(8): 575-81 (2000).
Pakula AA et al., "Genetic analysis of protein stability and function" Annual Review of Genetics vol. 23:289-310 (1989).
Dudich et al., "Isolation and Structural and Fuctional Characterization of Two Stable Peptic Fragments of Human alpah-Fetoprotein" Biochemistry, 38: 10406-10414 (1999).
Lafleur, David W., et al., "Chimeric Antigen Receptors Incorporating Novel (non-scFv) Binding Domains Targeting CD123 Direct Potent Antitumor Activity of T Cells: Correlation Between Affinity and Activity", Arcellx, Inc., presented at the American Association for Cancer Research 2020 Virtual Annual Meeting II, Jun. 22-24, 2020, Abstract 3243, 1 page.
Buonato, Janine et al., "Novel CAR-T Cell Therapy that can be Activated, Silenced, and Reprogrammed In Vivo with Soluble Protein Adapters in a Dose Dependent Manner", Arcellx, Inc., presented at the American Society of Gene & Cell Therapy Virtual Annual Meeting, May 12-15, 2020, Abstract 788, 1 page.
Unpublished U.S. Appl. No. 16/751,730, inventor: Lafleur, David William, filed Jan. 24, 2020.
Unpublished U.S. Appl. No. 16/824,809, inventor: Lafleur et al., filed Mar. 20, 2020.
Unpublished U.S. Appl. No. 16/763,784, inventor: Hilbert et al., filed May 13, 2020.
International Search Report for PCT/US2016/026054, filed on Apr. 5, 2016; dated Sep. 21, 2016.
Written Opinion of the International Searching Authority for PCT/US2016/026054, filed on Apr. 5, 2016; dated Sep. 21, 2016.
International Search Report for PCT/US2016/025880, filed on Apr. 4, 2016; dated Jul. 26, 2016.
Written Opinion of the International Searching Authority for PCT/US2016/025880, filed on Apr. 4, 2016; dated Jul. 26, 2016.
International Search Report for PCT/US2016/025868, filed on Apr. 4, 2016; dated Sep. 2, 2016.
Written Opinion of the International Searching Authority for PCT/US2016/025868, filed on Apr. 4, 2016; dated Sep. 2, 2016.
International Search Report and Written Opinion of the International Searching Authority for PCT/US2018/060902, filed on Nov. 14, 2018; dated Mar. 27, 2019.
International Search Report and Written Opinion of the International Searching Authority for PCT/US2018/060887, filed on Nov. 14, 2018; dated Apr. 1, 2019.
Walsh et al. "Solution structure and dynamics of a de novo designed three-helix bundle protein," Proceedings of the National Academy of Sciences, vol. 96, No. 10, pp. 5480-5491, May 11, 1999.
Unknown; Lipoprotein, UniProtKB database accession No. F2UEQ6, accessed at https://www.uniprot.org/uniprot/F2UEQ6 on May 20, 2019.

(56) References Cited

OTHER PUBLICATIONS

Unknown; Cytoplasmic dynein 2 heavy chain 1, UniProtKB database accession No. Q9SMH5, secondary accession No. Q9ZSS7, accessed at https://www.uniprot.org/uniprot/Q9SMH5 on May 20, 2019.
Unknown; Coiled-coil domain-containing protein 70, UniProtKB database accession No. T2MC19 , accessed at https://www.uniprot.org/uniprot/T2MC19 on May 20, 2019.
Unknown; Protein-disulfide isomerase, UniProtKB database accession No. S9SHI3, accessed at https://www.uniprot.org/uniprot/S9SHI3 on May 20, 2019.
Lafleur et al., "Monoclonal antibody therapeutics with up to five specificities: Functional enhancement through fusion of target-specific peptides" MABS vol. 5. No. 2 pp. 208-218, Mar. 1, 2013.
Per-Ake Nygren "Alternative binding proteins: Affibody binding proteins developed from a small three-helix bundle scaffold : Affibody binding proteins" FEBS Journal vol. 275. No. 11 pp. 2668-2676, Apr. 24, 2008.
Andreas Pluckthun "Designed Ankyrin Repeat Proteins (DARPins): Binding Proteins for Research. Diagnostics. And Therapy" Annual Review of Pharmacology and Toxicology vol. 55 No. 1 pp. 489-511, Jan. 6, 2015.
Walker et al., "Targeting high-risk pediatric solid tumors with CART cells directed against ALK (anaplastic lymphoma kinase, CD246);" J Immunother. Cancer, 2(Suppl 3):P40 (2014).
Mardiros et al. "T cells expressing CD123-specific chimeric antigen receptors exhibit specific cytolytic effector functions and antitumor effects against human acute myeloid leukemia" Blood 122(18). 3138-48 (2013).
Noad et al., "Virus-like particles as immunogens" Trends in Microbiology vol. 11. No. 9 pp. 438-444, Sep. 1, 2003.
Attwood, "The babel of bioinformatics," Science 290(5491):471-473 (2000).
Baker et al., "Protein Structure Prediction and Structural Genomics," Science, 294: 93-96 (2001).
Pakula et al., "Genetic analysis of protein stability and function," Annu. Rev. Genet., 23: 289-310 (1989).
Gilbreth et al., "Structural insights for engineering binding proteins based on non-antibody scaffolds," Current opinion in structural biology, 22:413-420 (2012).
Ngo et al., "Computational Complexity, Protein Structure Prediction, and the Levinthal Paradox," The Protein Folding Problem and Tertiary Structure Prediction, pp. 433 and 492-495 (1994).
Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," J. of Cell Bio., 111:2129-2138 (1990).
Lazar et al., "Transforming Growth Factor x; Mutation of Aspartic Acid 47 and Leucine 48 Results in Different Biological Activities," Molecular and Cellular Biology, 8(3):1247-1252 (1988).
Bowie et al., "Deciphering the Message in Protein Sequences: Tolerance to Amino Acid Substitutions," Science, 247:1306-1310 (1990).
Traxlmayr, et al., "Directed evolution of proteins for increased stability and expression using yeast display," Archives of Biochemistry Biophysics, 526:74-180 (2012).
Park et al., "Limitations of yeast surface display in engineering proteins of high thermostability," Protein Engineering, Design & Selection, 19(5:211-217 (2006).
Cangelosi et al., "A de novodesigned metalloenzyme for the hydration of $CO_2$," Angew Chem. Int. Ed Engl., 53(30)7900-7903 (2014).
Chakraborty et al., "Realization of a Designed Three-Helix Bundle Capable of Binding Heavy Metals in a Tris (Cysteine) Environment," Angew Chem. Int. Ed Engl., 50(9):2049-2053 (2011).
Mouratou et al., "Artificial Affinity Proteins as Ligands of Immunoglobulins," Biomolecules, 5:60-75 (2015).
Löfblom et al., "Affibody molecules: Engineered proteins for therapeutic, diagnostic and biotechnological applications," FEBS Letters; 584:2670-2680 (2010).
Ronnmark et al., "Human Immunoglobulin A (IgA)-specific ligands from combinatorial engineering of protein A," Eur. J. Biochem., 269:2647-2655 (2002).
Kuchar et al., "Human interleukin-23 receptor antagonists derived from an albumin-binding domain scaffold inhibit IL-23-dependent ex vivo expansion of IL-17-producing T-cells," 82:975-989 (2013).
Heiko et al., "Short term culture of breast tissues to study the activity of the anticancer drug taxol in an intact tumor environment," BMC Cancer 2006, 6: 86, pp. 1-11 (Year:2006).
Hey et al., "Artificial, non-antibody binding proteins for pharmaceutical and industrial applications." TRENDS Biotechnol. 23(10): 514-522 (2005).

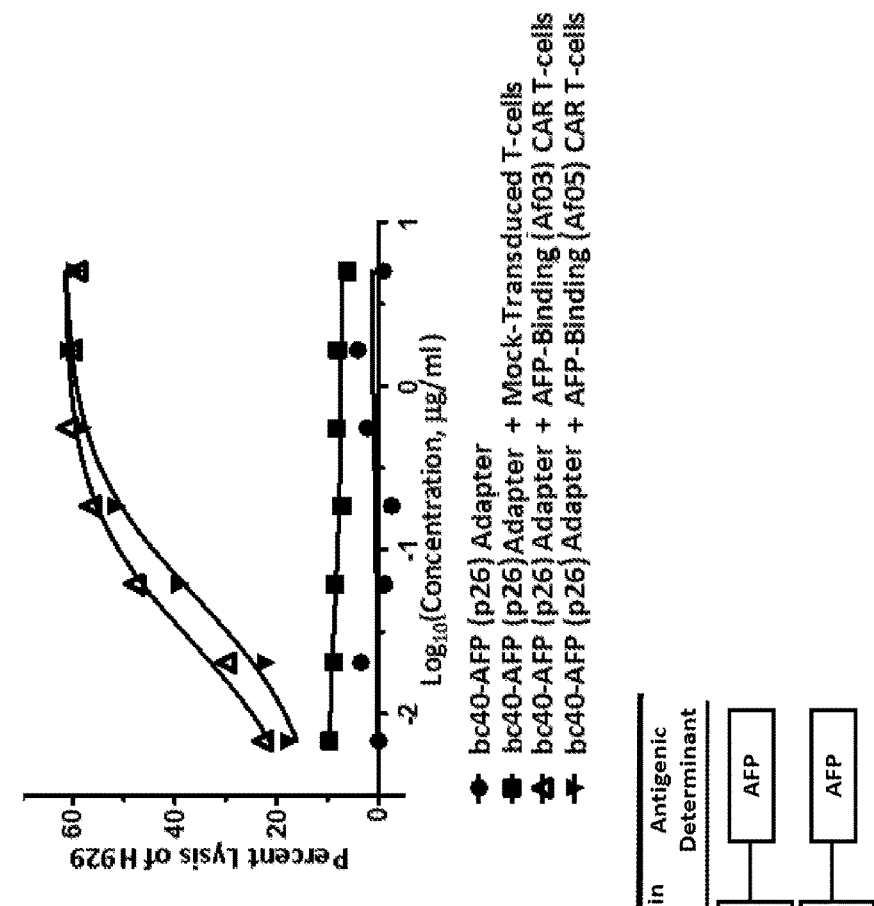
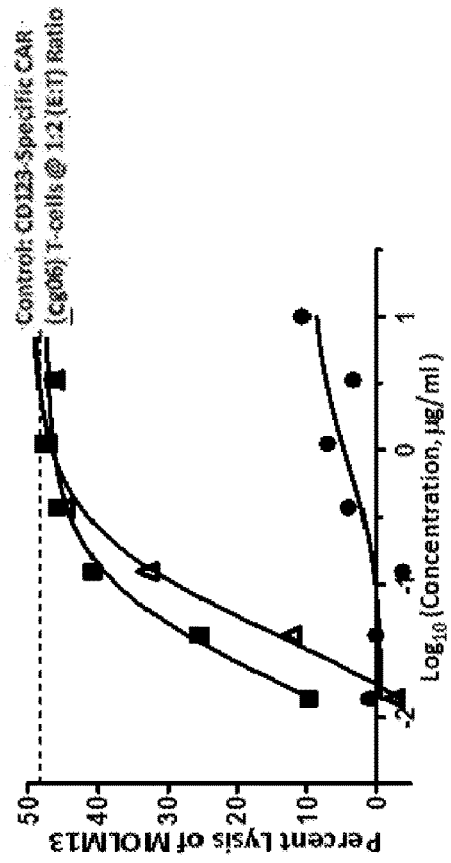
FIG. 3B
FIG. 3C

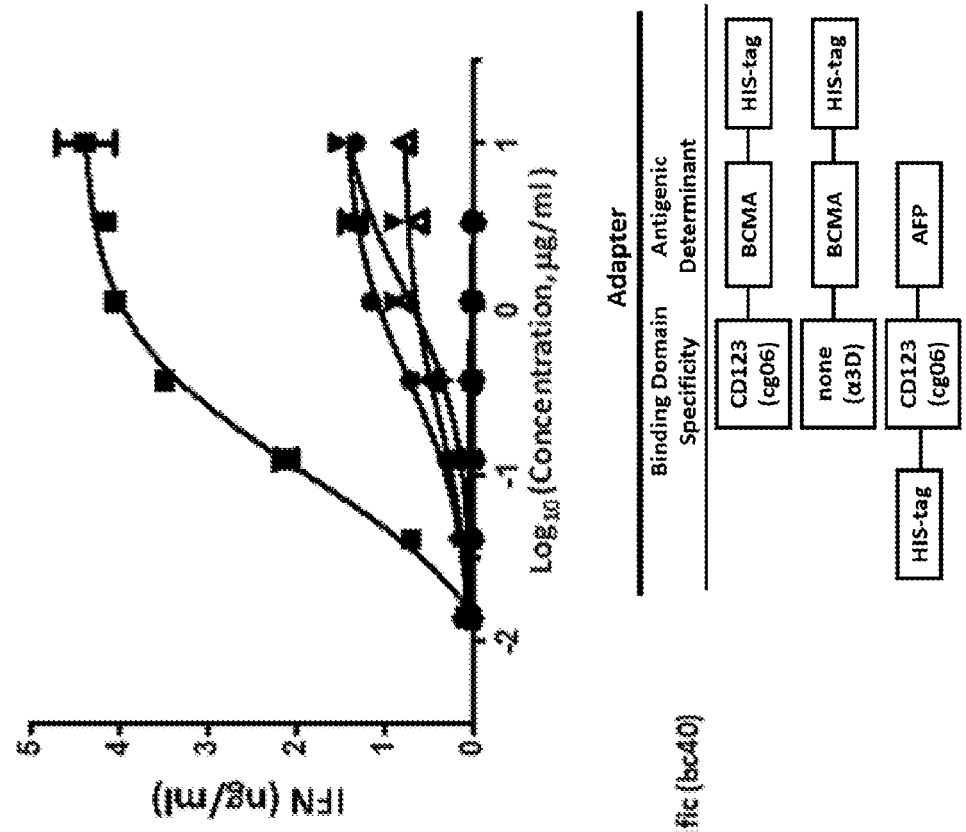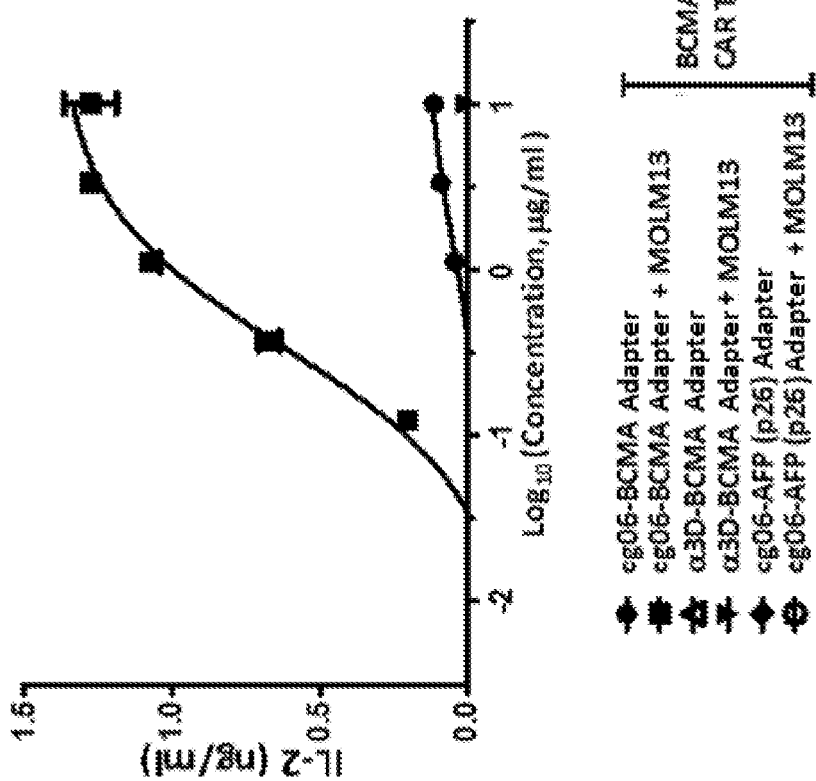
FIG. 4A
FIG. 4B

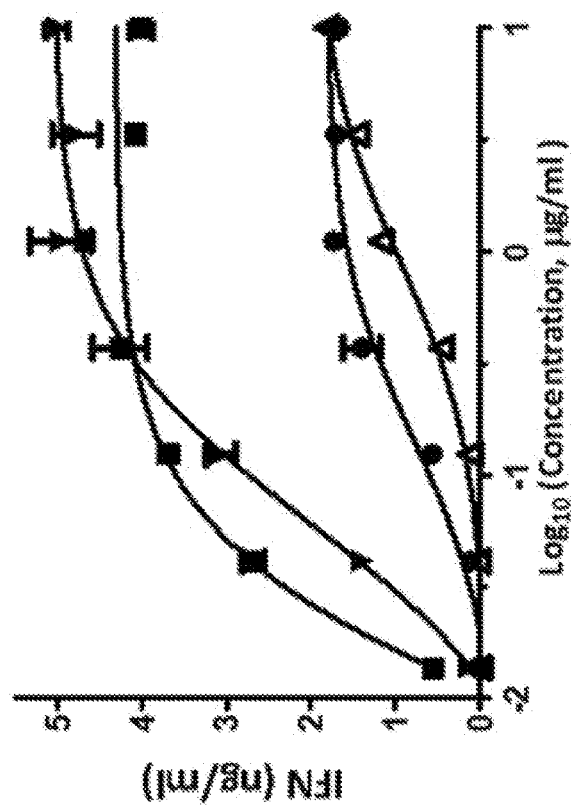
FIG. 4C
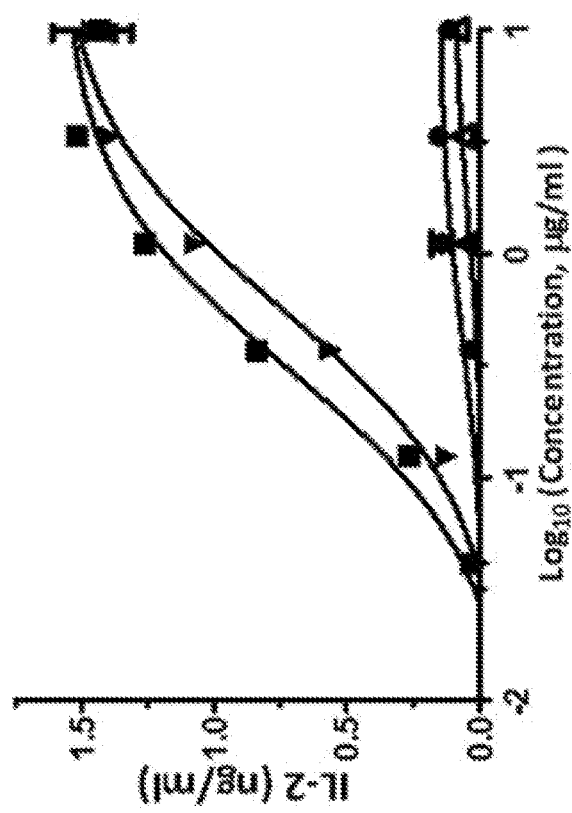
FIG. 4D
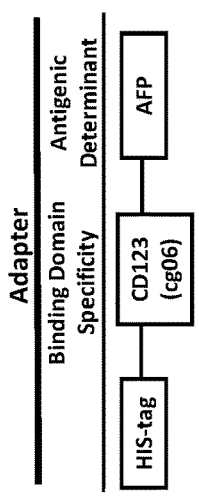

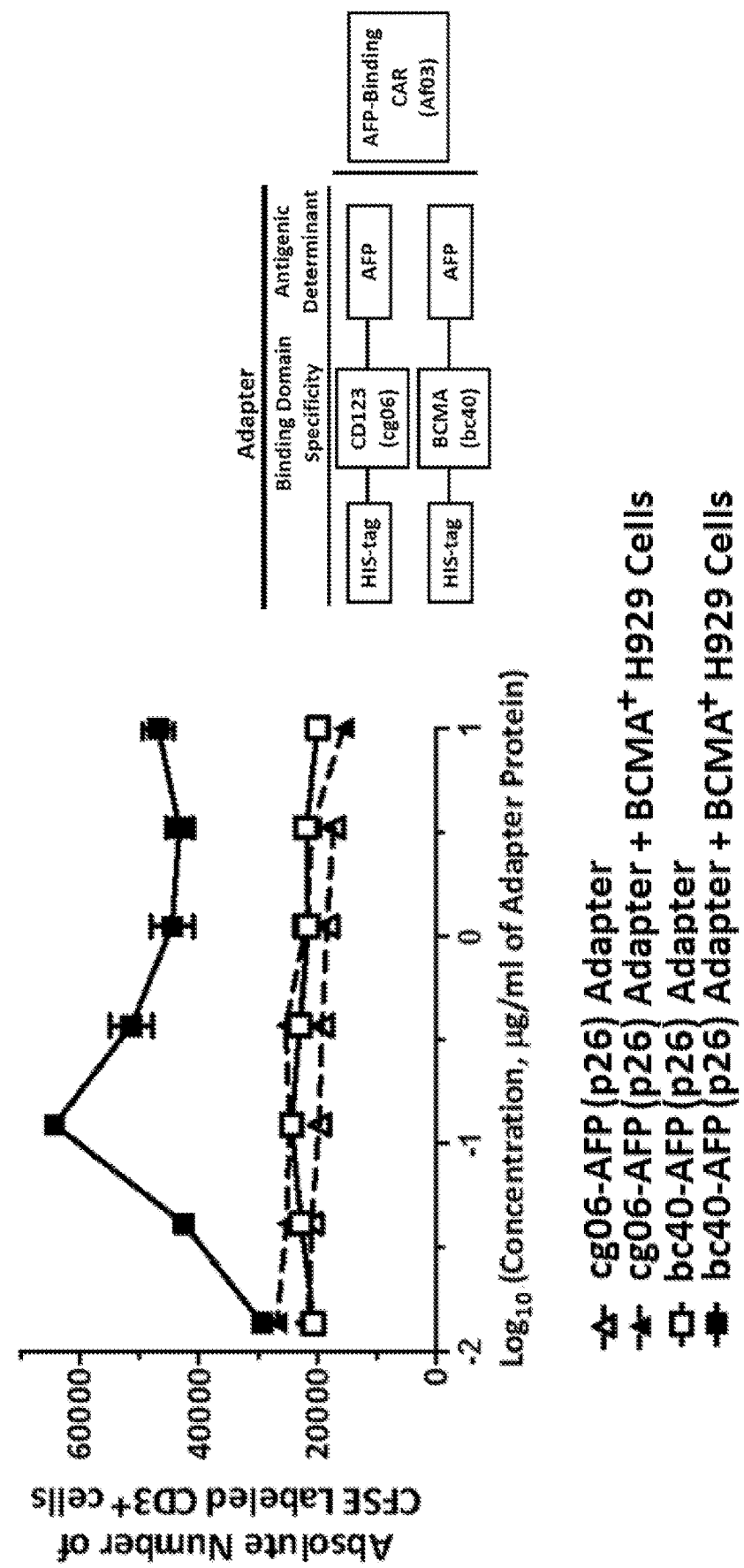

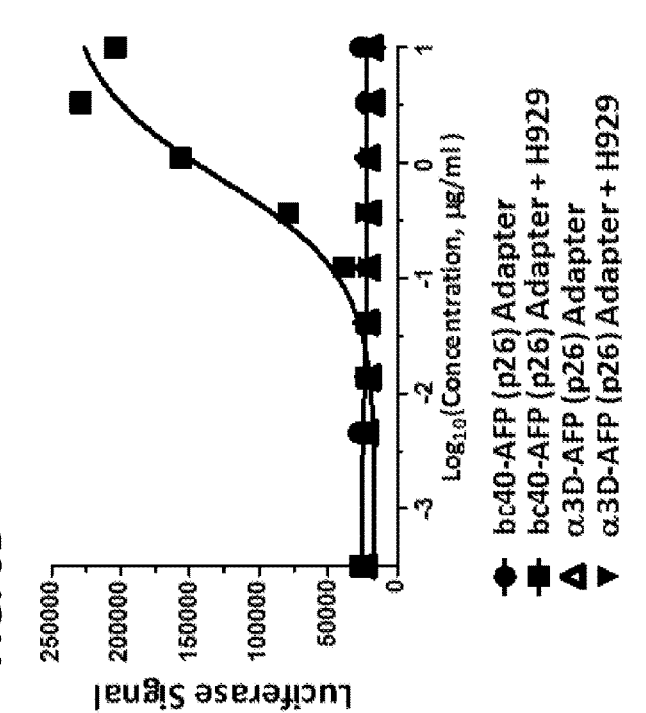
FIG. 6B
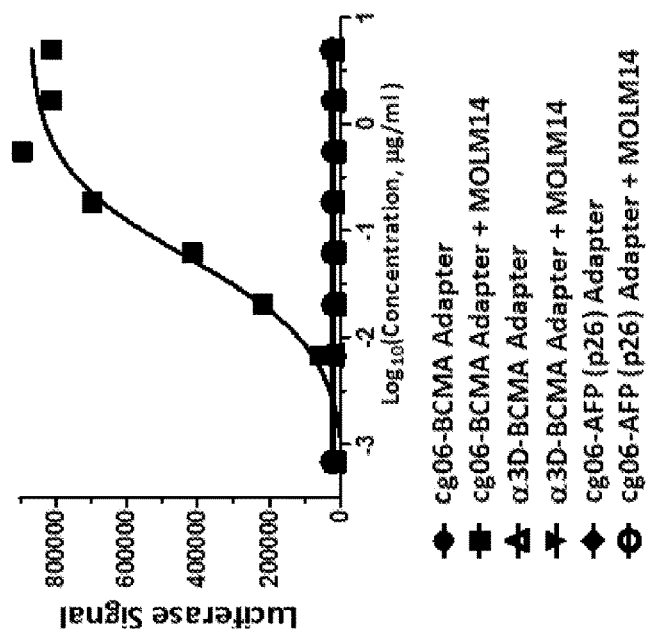
FIG. 6A
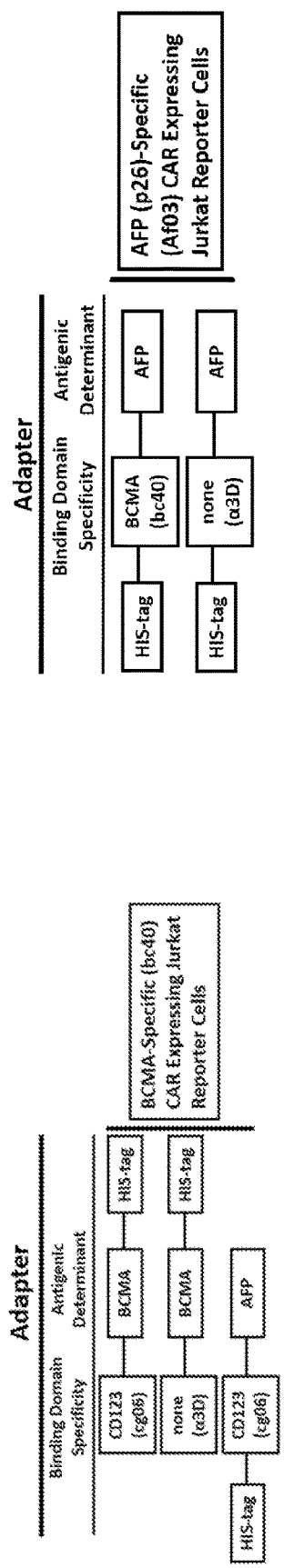

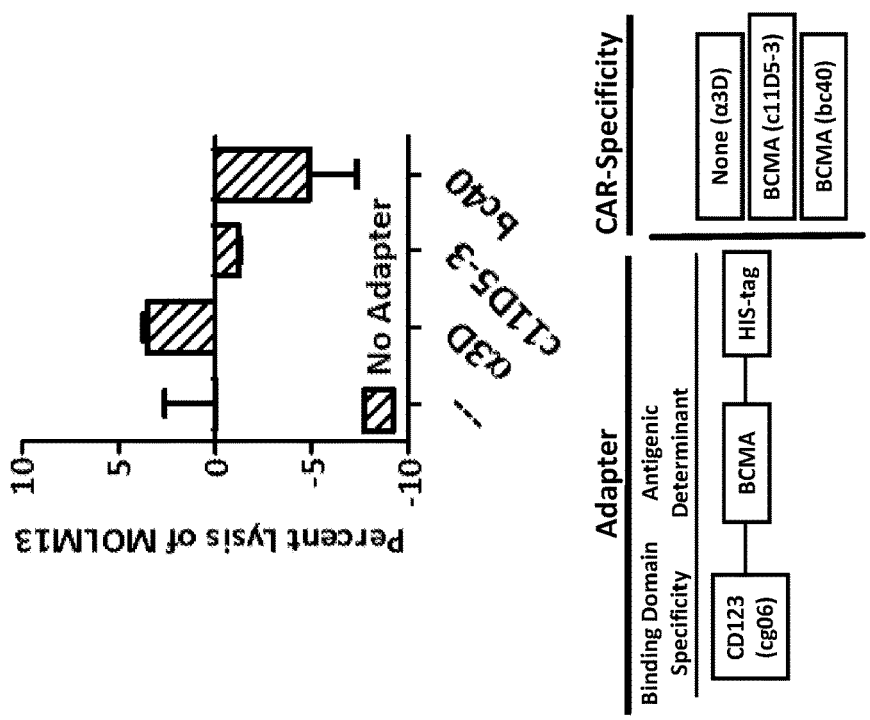
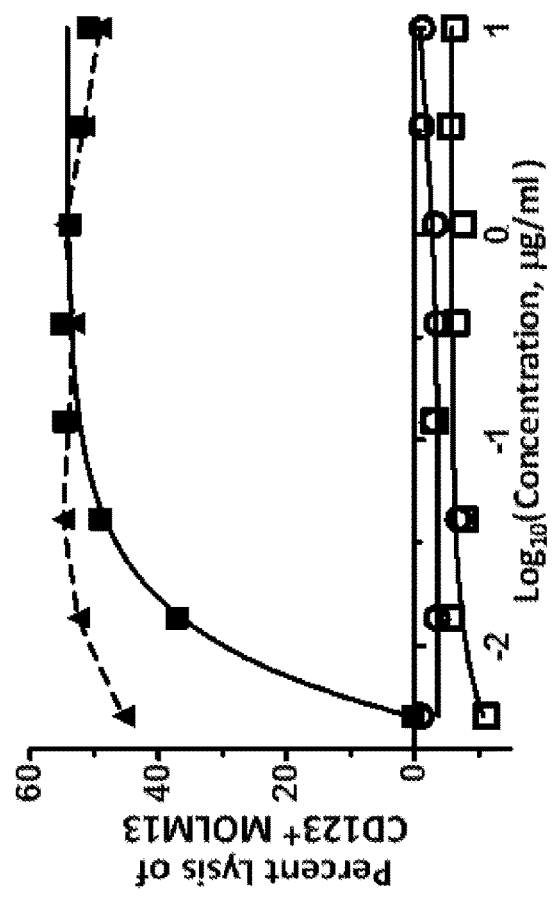
FIG. 7A
FIG. 7B

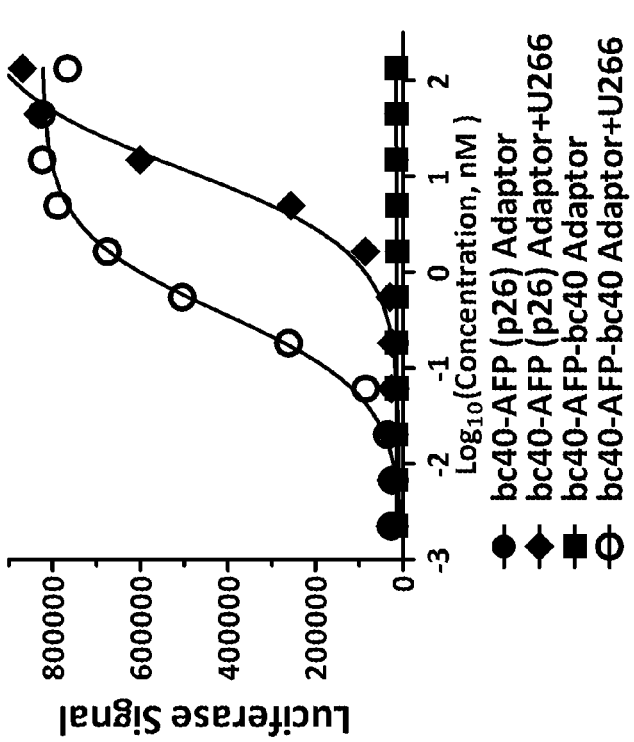
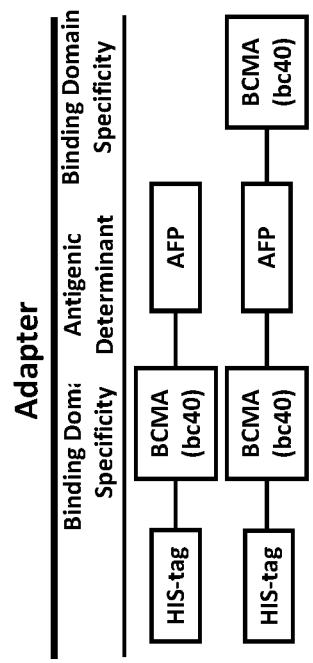
FIG. 9A
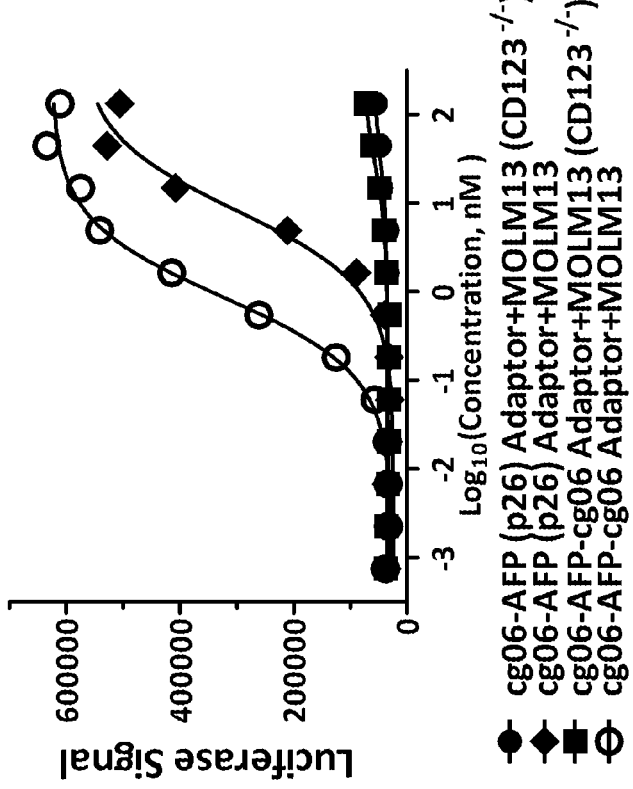
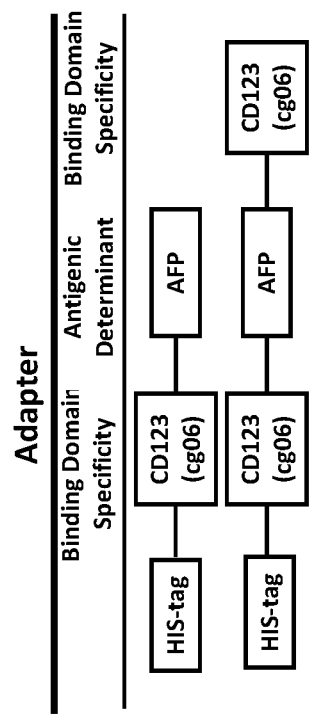
FIG. 9B

FIG. 12B

C1249: a3D(Q19E).3xGS.p26.3xGS.a3D(Q19E).HIS
C1541: a3D(Q19E).3xGS.p26.3xGS.eb08.HIS
C1566: a3D(Q19E).3xGS.p26.3xGS.zHER2(4).HIS
C1567: a3D(Q19E).3xGS.p26.3xGS.zHER2(342).HIS
C1568: a3D(Q19E).3xGS.p26.3xGS.G3_DARPin.HIS
C1569: a3D(Q19E).3xGS.p26.3xGS.9.29_DARPin.HIS

MULTIFUNCTIONAL IMMUNE CELL THERAPIES

CROSS-REFERENCE TO RELATED APPLICATIONS

This application is a U.S. National Phase of PCT Application No. PCT/US2018/060902, filed Nov. 14, 2018, which claims the benefit of U.S. Provisional Patent Application No. 62/585,770, filed Nov. 14, 2017, and also claims the benefit of U.S. Provisional Patent Application No. 62/717,165, filed Aug. 10, 2018, each of which is incorporated herein by reference in its entirety.

REFERENCE TO SEQUENCE LISTING SUBMITTED ELECTRONICALLY

The content of the electronically submitted sequence listing (Name: 6666.0110_Sequence_Listing_ST25.txt; Size: 1,115,372 bytes; and Date of Creation: Sep. 21, 2020) filed with the application is incorporated herein by reference in its entirety.

BACKGROUND

The adoptive transfer of genetically modified T cells is a rapidly evolving innovative treatment for cancer. Chimeric antigen receptor (CAR) engineered T cells are renewable drugs with the capacity to provide sustained functional immunity. Clinical efficacy has been demonstrated with CD19 CAR T in a range of hematological cancers and encouraging early clinical data has been reported for other genetically modified CAR T in solid tumors. However, significant challenges must be met before CAR technology can more fully realize its substantial potential.

Current clinical trials with CAR T cells observe a high incidence of relapse in one year or less due to the inability of CAR T cells to address antigen escape and the inherent heterogeneity in the cancer or tumor phenotype. Moreover, current CAR technologies are not adaptive to such changes in cancer or tumor phenotype. In solid tumors, for example, current CAR technologies exhibit limited efficacy due to tumor target heterogeneity and the inability to reprogram CAR T cells to recognize an expanded set of antigenic targets expressed over time. In addition to improving the durability and sustainability of clinical responses, other key impediments to the use of current CAR cell-based technologies include the time required to generate CAR T cells, and the suboptimal specificity, efficacy, and safety of CAR cells for use in cancers beyond leukemia. Accordingly, there is a need for CAR cell-based technology that provides simultaneous and/or sequential target multispecificity and the ability to modulate, alter, or redirect CAR cell-mediated immune responses in vivo.

Bone marrow transplantation (BMT) and hematopoietic stem cell transplantation (HSCT) hold the promise of correcting any blood or immune disease. Czechowicz et al., Blood 128 (22): 493 (2016). Despite their tremendous potential, the clinical use of BMT and HSCT remain fairly limited in part due to the severe safety and toxicity risks associated with current high dose chemotherapy/irradiation conditioning regimens to prepare patients for transplant and subsequent donor HSC engraftment. The most common toxicities experienced by patients include neutropenia, infections, anemia, mucositis, infertility, organ damage particularly in the bone marrow compartment and secondary malignancies. Complete elimination of these toxic conditioning regimens would dramatically improve the safety profile of BMT and HSCT and expand the potential applications to include many more non-malignant hematologic disorders, a wide variety of autoimmune disorders, as well as facilitate solid organ transplant. Accordingly, there is a need for the development of improved conditioning regimens that limit or eliminate toxicities associated with current high dose chemotherapy/irradiation while also effectively treating the underlying disease state.

BRIEF SUMMARY

Provided herein are multi-functional chimeric antigen receptor (CAR)-based compositions and their use in directing immune responses to target cells. The compositions have uses that include treating hyperproliferative disorders such as cancer. The provided methods generally include the use of a CAR cell in combination with an Adapter. The Adapter confers the ability to modulate, alter, and/or redirect CAR cell-mediated immune response in vitro and in vivo.

The present disclosure relates to compositions comprising: (a) a cell expressing a chimeric antigen receptor (CAR), wherein the CAR comprises an antigenic determinant binding domain (ADBD), and (b) a soluble protein (an "Adapter") which comprises (i) an antigenic determinant (AD) and (ii) and an ADBD. The present disclosure also provides methods of killing a target cell with the compositions provided herein, including therapeutic applications of the compositions provided herein.

In some embodiments, the disclosure provides a composition comprising: (a) a cell expressing a CAR, wherein the CAR comprises an (i) an ADBD that binds to a first AD on a target cell, (ii) a transmembrane domain, and (iii) an intracellular domain; and (b) an Adapter which comprises (i) said first AD and (ii) an ADBD that binds to a second AD on said target cell.

In some embodiments, the disclosure provides a composition comprising: (a) a cell expressing a CAR, wherein the CAR comprises (i) an ADBD that binds to a first AD on a target cell, (ii) a transmembrane domain, and (iii) an intracellular domain; and (b) an Adapter which comprises (i) said first AD and (ii) an ADBD that binds to a second AD on a second target cell.

In some embodiments, the disclosure provides a composition comprising: (a) a cell expressing a CAR, wherein the CAR comprises (i) an ADBD that is an alternative scaffold binding domain (ASBD) that binds to a first AD, (ii) a transmembrane domain, and (iii) an intracellular domain; and (b) an Adapter which comprises (i) said first AD and (ii) an ADBD that binds to a second AD on a target cell.

In some embodiments, the disclosure provides a composition comprising: (a) a cell expressing a CAR, wherein the CAR comprises (i) an ADBD that binds to a first AD, (ii) a transmembrane domain, and (iii) an intracellular domain; and (b) an Adapter which comprises (i) said first AD and (ii) an ADBD comprising an ASBD that binds to a second AD on a target cell.

In some embodiments, the disclosure provides a composition comprising: (a) a cell expressing a CAR, wherein the CAR comprises (i) an ADBD that binds to a first AD, (ii) a transmembrane domain, and (iii) an intracellular domain; and (b) an Adapter which comprises (i) said first AD and (ii) a D domain that binds to a second AD on a target cell.

In some embodiments, the disclosure provides a composition comprising: (a) a cell expressing a CAR, wherein the CAR comprises (i) a D domain that binds to a first AD, (ii) a transmembrane domain, and (iii) an intracellular domain;

and (b) an Adapter which comprises (i) said first AD and (ii) an ADBD that binds to a second AD on a target cell.

In some embodiments, the disclosure provides a composition comprising: (a) a cell expressing a CAR, wherein the CAR comprises (i) a first D domain that binds to a first AD, (ii) a transmembrane domain, and (iii) an intracellular domain; and (b) an Adapter which comprises (i) said first AD and (ii) a second D domain that binds to a second AD on a target cell.

In some embodiments, the disclosure provides a method of killing a target cell comprising contacting a composition comprising a target cell with an Adapter, wherein (a) the composition comprising the target cell further comprises a cell expressing a CAR, wherein the CAR comprises (i) an ADBD that binds to a first AD on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of killing one or more target cells comprising contacting a composition comprising a first target cell with an Adapter, wherein (a) the composition comprising the target cell further comprises a cell expressing a CAR, wherein the CAR comprises (i) an ADBD that binds to a first AD on said first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of killing a target cell comprising contacting a composition comprising a target cell with an Adapter, wherein (a) the composition comprising the target cell further comprises a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of killing a target cell comprising contacting a composition comprising a target cell with an Adapter, wherein (a) the composition comprising the target cell further comprises a cell expressing a CAR, wherein the CAR comprises (i) an ADBD that binds to a first AD, (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of killing a target cell comprising contacting a composition comprising a target cell with a cell expressing a CAR, wherein (a) a first AD is present on the target cell; (b) the composition comprising the first target cell further comprises an Adapter comprising (i) said first AD and (ii) an ADBD that binds to a second AD on the target cell; and (c) the CAR comprises (i) an ADBD that binds to said first AD on the target cell or the Adapter, (ii) a transmembrane domain, and (iii) an intracellular domain.

In some embodiments, the disclosure provides a method of killing one or more target cells comprising contacting a composition comprising a target cell with a cell expressing a CAR, wherein (a) a first AD is present on the first target cell; (b) the composition comprising the first target cell further comprises a second target cell and an Adapter comprising (i) said first AD and (ii) an ADBD that binds to a second AD on a second target cell; and (c) the CAR comprises (i) an ADBD that binds to said first AD on the first target cell or the Adapter, (ii) a transmembrane domain, and (iii) an intracellular domain.

In some embodiments, the disclosure provides a method of killing a target cell comprising contacting a composition comprising a target cell with a cell expressing a CAR, wherein (a) a first AD is present on the target cell; (b) the composition comprising the target cell further comprises an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides a method of killing a target cell comprising contacting a composition comprising a target cell with a cell expressing a CAR, wherein (a) a first AD is present on the target cell; (b) the composition comprising the target cell further comprises an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of delivering an immune response to a target cell comprising contacting a composition comprising a target cell with an Adapter, wherein (a) the composition comprising the target cell further comprises a cell expressing a CAR, wherein the CAR comprises (i) an ADBD that binds to a first AD on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of delivering an immune response to one or more target cells comprising contacting a composition comprising a first target cell with an Adapter, wherein (a) the composition comprising the target cell further comprises a cell expressing a CAR, wherein the CAR comprises (i) an ADBD that binds to a first AD on said first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of delivering an immune response to a target cell comprising contacting a composition comprising a target cell with an Adapter, wherein (a) the composition comprising the target cell further comprises a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of delivering an immune response to a target cell comprising contacting a composition comprising a target cell with an Adapter, wherein (a) the composition comprising the target cell further comprises a cell expressing a CAR, wherein the CAR comprises (i) an ADBD that binds to a first AD, (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of delivering an immune response to a target cell comprising contacting a composition comprising a target cell with a CAR, wherein (a) a first AD is present on the target cell; (b) the composition comprising the first target cell further comprises an Adapter comprising (i) said first AD and (ii) an ADBD that binds to a second AD on the target cell; and (c)

the CAR comprises (i) an ADBD that binds to said first AD on the target cell or the Adapter, (ii) a transmembrane domain, and (iii) an intracellular domain.

In some embodiments, the disclosure provides a method of delivering an immune response to one or more target cells comprising contacting a composition comprising a target cell with a cell expressing a CAR, wherein (a) a first AD is present on the first target cell; (b) the composition comprising the first target cell further comprises a second target cell and an Adapter comprising (i) said first AD and (ii) an ADBD that binds to a second AD on a second target cell; and (c) the CAR comprises (i) an ADBD that binds to said first AD on the first target cell or the Adapter, (ii) a transmembrane domain, and (iii) an intracellular domain.

In some embodiments, the disclosure provides a method of delivering an immune response to a target cell comprising contacting a composition comprising a target cell with a CAR, wherein (a) a first AD is present on the target cell; (b) the composition comprising the target cell further comprises an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides a method of delivering an immune response to a target cell comprising contacting a composition comprising a target cell with a CAR, wherein (a) a first antigenic determinant (AD) is present on the target cell; (b) the composition comprising the target cell further comprises an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of killing a target cell in a patient comprising administering an Adapter to the patient, wherein (a) the patient has been treated with a cell expressing a CAR, wherein the CAR comprises (i) an ADBD that binds to a first AD on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of redirecting target cell killing in a patient comprising administering an Adapter to the patient, wherein (a) the patient has been treated with a cell expressing a CAR, wherein the CAR comprises (i) an ADBD that binds to a first AD on a first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of killing a target cell in a patient comprising administering an Adapter to the patient, wherein (a) the patient has been treated with a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of killing a target cell in a patient comprising administering an Adapter to the patient, wherein (a) the patient has been treated with a cell expressing a CAR, wherein the CAR comprises (i) an ADBD that binds to a first AD, (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of killing a target cell in a patient comprising administering a cell expressing a CAR to the patient, wherein (a) a first AD and a second AD is present on the target cell; (b) the patient has been treated with an Adapter comprising (i) said first AD and (ii) an ADBD that binds to said second AD on said target cell; and (c) the CAR comprises (i) an ADBD that binds to said first AD on the target cell or the Adapter, (ii) a transmembrane domain, and (iii) an intracellular domain.

In some embodiments, the disclosure provides a method of directing target cell killing in a patient comprising administering a cell expressing a CAR to the patient, wherein (a) the patient has been treated with an Adapter comprising (i) a first AD and (ii) an ADBD that binds to a second AD on the target cell; and (b) the CAR comprises (i) an ADBD that binds to said first AD on the Adapter, (ii) a transmembrane domain, and (iii) an intracellular domain.

In some embodiments, the disclosure provides a method of killing a target cell in a patient comprising administering a cell expressing a CAR to the patient, wherein (a) a first AD is present on the target cell; (b) the patient has been treated with an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides a method of killing a target cell in a patient comprising administering a cell expressing a CAR to the patient, wherein (a) a first AD is present on the target cell; (b) the patient has been treated with an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of delivering an immune response to a target cell in a patient comprising administering an Adapter to the patient, wherein (a) the patient has been treated with a cell expressing a CAR, wherein the CAR comprises (i) an ADBD that binds to a first AD on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of redirecting an immune response to a target cell in a patient comprising administering an Adapter to the patient, wherein (a) the patient has been treated with a cell expressing a CAR, wherein the CAR comprises (i) an ADBD that binds to a first AD on a first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of delivering an immune response to a target cell in a patient comprising administering an Adapter to the patient, wherein (a) the patient has been treated with a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of delivering an immune response to a target cell in a patient comprising administering an Adapter to the patient, wherein (a) the patient has been treated with a cell expressing a CAR, wherein the CAR comprises (i) an ADBD that binds to a first AD, (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of delivering an immune response to a target cell in a patient comprising administering a cell expressing a CAR to the patient, wherein (a) a first AD and a second AD is present on the target cell; (b) the patient has been treated with an Adapter comprising (i) said first AD and (ii) an ADBD that binds to said second AD on said target cell; and (c) the CAR comprises (i) an ADBD that binds to said first AD on the target cell or the Adapter, (ii) a transmembrane domain, and (iii) an intracellular domain.

In some embodiments, the disclosure provides a method of directing an immune response to a target cell in a patient comprising administering a cell expressing a CAR to the patient, wherein (a) the patient has been treated with an Adapter comprising (i) a first AD and (ii) an ADBD that binds to a second AD on the target cell; and (b) the CAR comprises (i) an ADBD that binds to said first AD on the Adapter, (ii) a transmembrane domain, and (iii) an intracellular domain.

In some embodiments, the disclosure provides a method of delivering an immune response to a target cell in a patient comprising administering a cell expressing a CAR to the patient, wherein (a) a first AD is present on the target cell; (b) the patient has been treated with an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides a method of delivering an immune response to a target cell in a patient comprising administering a cell expressing a CAR to the patient, wherein (a) a first AD is present on the target cell; (b) the patient has been treated with a an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of treating proliferative disorder, cancer, autoimmune disease, infection, or allograft rejection comprising contacting a composition comprising a target cell with a cell expressing a CAR, wherein (a) a first AD is present on the target cell; (b) the composition comprising the target cell further comprises an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of treating proliferative disorder, cancer, autoimmune disease, infection, or allograft rejection comprising administering an Adapter to the patient, wherein (a) the patient has been treated with a cell expressing a CAR, wherein the CAR comprises (i) an ADBD that binds to a first AD on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of redirecting treatment of a proliferative disorder, cancer, autoimmune disease, infection, or allograft rejection comprising administering an Adapter to the patient, wherein (a) the patient has been treated with a cell expressing a CAR, wherein the CAR comprises (i) an ADBD that binds to a first AD on a first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of treating proliferative disorder, cancer, autoimmune disease, infection, or allograft rejection comprising administering an Adapter to the patient, wherein (a) the patient has been treated with a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of treating proliferative disorder, cancer, autoimmune disease, infection, or allograft rejection comprising administering an Adapter to the patient, wherein (a) the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of treating proliferative disorder, cancer, autoimmune disease, infection, or allograft rejection comprising administering a cell expressing a CAR to the patient, wherein (a) a first AD and a second AD is present on the target cell; (b) the patient has been treated with an Adapter comprising (i) said first AD and (ii) an ADBD that binds to said second AD on said target cell; and (c) the CAR comprises (i) an ADBD that binds to said first AD on the target cell or the Adapter, (ii) a transmembrane domain, and (iii) an intracellular domain.

In some embodiments, the disclosure provides a method of directing treatment of a proliferative disorder, cancer, autoimmune disease, infection, or allograft rejection comprising administering a cell expressing a CAR to the patient, wherein (a) the patient has been treated with an Adapter comprising (i) a first AD and (ii) an ADBD that binds to second AD on the target cell; and (b) the CAR comprises (i) an ADBD that binds to said first AD on the Adapter, (ii) a transmembrane domain, and (iii) an intracellular domain.

In some embodiments, the disclosure provides a method of treating proliferative disorder, cancer, autoimmune disease, infection, or allograft rejection comprising administering a cell expressing a CAR to the patient, wherein (a) a first AD is present on the target cell; (b) the patient has been treated with an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides a method of treating a proliferative disorder, cancer, autoimmune disease, infection, or allograft rejection comprising administering a cell expressing a CAR to the patient, wherein (a) a first AD is present on the target cell; (b) the patient has been treated with a an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of treating hematological cancer comprising contacting a composition comprising a target cell with a cell expressing a CAR, wherein (a) a first AD is present on the target cell; (b) the composition comprising the target cell further comprises an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides a method of treating hematological cancer comprising administering an Adapter to the patient, wherein (a) the patient has been treated with a cell expressing a CAR, wherein the CAR comprises (i) an ADBD that binds to a first antigenic determinant (AD) on said target cell, (ii) a transmembrane domain, and (iii) an intracellular domain; and (b) the Adapter comprises (i) said first AD and (ii) an ADBD that binds to a second AD on said target cell.

In some embodiments, the disclosure provides a method of redirecting treatment of a hematological cancer comprising administering an Adapter to the patient, wherein (a) the patient has been treated with a cell expressing a CAR, wherein the CAR comprises (i) an ADBD that binds to a first AD on a first target cell, (ii) a transmembrane domain, and (iii) an intracellular domain; and (b) the Adapter comprises (i) said first AD and (ii) an ADBD that binds to a second AD on a second target cell.

In some embodiments, the disclosure provides a method of treating hematological cancer comprising administering an Adapter to the patient, wherein (a) the patient has been treated with a cell expressing a CAR, wherein the CAR comprises (i) an ADBD that is an ASBD that binds to a first AD, (ii) a transmembrane domain, and (iii) an intracellular domain; and (b) the Adapter comprises (i) said first AD and (ii) an ADBD that binds to a second AD on said target cell.

In some embodiments, the disclosure provides a method of treating hematological cancer comprising administering an Adapter to the patient, wherein (a) the patient has been treated with a cell expressing a CAR, wherein the CAR comprises (i) an ADBD that binds to a first AD, (ii) a transmembrane domain, and (iii) an intracellular domain; and (b) the Adapter comprises (i) said first AD and (ii) an ADBD that is an ASBD that binds to a second AD on said target cell.

In some embodiments, the disclosure provides a method of treating hematological cancer comprising administering a cell expressing a CAR to the patient, wherein (a) a first AD and a second AD is present on the target cell; (b) the patient has been treated with an Adapter comprising (i) said first AD and (ii) an ADBD that binds to said second AD on said target cell; and (c) the CAR comprises (i) an ADBD that binds to said first AD on the target cell or the Adapter, (ii) a transmembrane domain, and (iii) an intracellular domain.

In some embodiments, the disclosure provides a method of directing treatment of a hematological cancer comprising administering a cell expressing a CAR to the patient, wherein (a) the patient has been treated with an Adapter comprising (i) a first AD and (ii) an ADBD that binds to a second AD on the target cell; and (b) the CAR comprises (i) an ADBD that binds to said first AD on the Adapter, (ii) a transmembrane domain, and (iii) an intracellular domain.

In some embodiments, the disclosure provides a method of treating hematological cancer comprising administering a cell expressing a CAR to the patient, wherein (a) a first AD is present on the target cell; (b) the patient has been treated with an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In some embodiments, the disclosure provides method of treating hematological cancer comprising administering a cell expressing a CAR to the patient, wherein (a) a first AD is present on the target cell; (b) the patient has been treated with a an Adapter comprising (i) an ADBD that is an ASBD that binds to said first AD on said target cell and (ii) a second AD; and (c) the CAR comprises (i) an ADBD that binds to said second AD, (ii) a transmembrane domain, and (iii) an intracellular domain.

In some embodiments, the disclosure provides an engineered human immune effector cell comprising (a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and (b) a genetic modification that eliminates the expression of the human CD45 AD on the engineered cell, wherein the engineered cell is capable of directing an immune response to a CD45 AD expressing cell in an in vitro assay, and wherein the engineered cell does not express the CD45 AD.

In some embodiments, the disclosure provides a method of killing a human CD45 expressing target cell comprising contacting the target cell with an engineered human immune effector cell, wherein the engineered human immune effector cell comprises (a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and (b) a genetic modification that eliminates the expression of the human CD45 AD on the engineered cell.

In some embodiments, the disclosure provides a method of delivering an immune response to a human CD45 expressing target cell comprising contacting the target cell with an engineered human immune effector cell, wherein the engineered human immune effector cell comprises (a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and (b) a genetic modification that eliminates the expression of the human CD45 AD on the engineered cell.

In some embodiments, the disclosure provides a method of treating a proliferative disorder, cancer, autoimmune disease, infection, or allograft rejection in a subject comprising administering to the subject in need thereof a therapeutically effective amount of an engineered human immune effector cell, wherein the engineered human immune effector cell comprises (a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and (b) a genetic modification that eliminates the expression of the human CD45 AD on the engineered cell.

In some embodiments, the disclosure provides an engineered human immune effector cell comprising (a) a chimeric antigen receptor (CAR) comprising (1) a first antigenic determinant binding domain (ADBD) that specifically binds to a first antigenic determinant (AD), (2) a transmembrane domain, and (3) an intracellular domain; and (b) a genetic modification that eliminates the expression of at least one human CD45 AD on the engineered cell, wherein the first AD is not the at least one human CD45 AD, wherein the engineered cell used in combination with an Adapter is capable of directing an immune response to a CD45 expressing cell in an in vitro assay, wherein the Adapter comprises the first AD and a second ADBD that specifically binds to the at least one human CD45 AD, and wherein the engineered cell does not express the at least one human CD45 AD.

In some embodiments, the disclosure provides a method of killing a target cell comprising contacting the target cell with an engineered human immune effector cell and an Adapter, wherein the target cell expresses CD45, wherein the engineered human immune effector cell comprises (a) a chimeric antigen receptor (CAR) comprising (1) a first antigenic determinant binding domain (ADBD) that specifically binds to a first antigenic determinant (AD), (2) a transmembrane domain, and (3) an intracellular domain; and (b) a genetic modification that eliminates the expression of at least one human CD45 AD on the engineered cell, and wherein the Adapter comprises the first AD and a second ADBD that specifically binds to a human CD45 AD.

In some embodiments, the disclosure provides a method of delivering an immune response to a target cell comprising contacting the target cell with an engineered human immune effector cell and an Adapter, wherein the target cell expresses CD45, wherein the engineered human immune effector cell comprises (a) a chimeric antigen receptor (CAR) comprising (1) a first antigenic determinant binding domain (ADBD) that specifically binds to a first antigenic determinant (AD), (2) a transmembrane domain, and (3) an intracellular domain; and (b) a genetic modification that eliminates the expression of at least one human CD45 AD on the engineered cell, and wherein the Adapter comprises the first AD and a second ADBD that specifically binds to a human CD45 AD.

In some embodiments, the disclosure provides a method of directing an immune response to a CD45 expressing target cell in a subject comprising (a) administering to the subject in need thereof a therapeutically effective amount of an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell; and (b) administering to the subject a therapeutically effective amount of an Adapter comprising the first AD and a second ADBD that specifically binds to a human CD45 AD.

In some embodiments, the disclosure provides a method of directing an immune response to a CD45 expressing target cell in a subject comprising administering to the subject in need thereof a therapeutically effective amount of an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell, wherein the subject has been administered an Adapter comprising the first AD and a second ADBD that specifically binds to a human CD45 AD.

In some embodiments, the disclosure provides a method of directing an immune response to a CD45 expressing target cell in a subject comprising administering to the subject in need thereof a therapeutically effective amount of an Adapter comprising the first AD and a second ADBD that specifically binds to a human CD45 AD, wherein the subject has been administered an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell.

In some embodiments, the disclosure provides a method of treating a proliferative disorder, cancer, autoimmune disease, infection, or allograft rejection in a subject comprising (a) administering to the subject in need thereof a therapeutically effective amount of an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell; and (b) administering to the subject a therapeutically effective amount of an Adapter comprising the first AD and a second ADBD that specifically binds to a human CD45 AD.

In some embodiments, the disclosure provides a method of treating a proliferative disorder, cancer, autoimmune disease, infection, or allograft rejection in a subject comprising administering to the subject in need thereof a therapeutically effective amount of an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell, wherein the subject has been administered an Adapter comprising the first AD and a second ADBD that specifically binds to a human CD45 AD.

In some embodiments, the disclosure provides a method of treating a proliferative disorder, cancer, autoimmune disease, infection, or allograft rejection in a subject comprising administering to a subject in need thereof a therapeutically effective amount of an Adapter comprising the first AD and a second ADBD that specifically binds to a human CD45 AD, wherein the subject has been administered an engineered human immune effector cell comprising (i) a chimeric antigen receptor (CAR) comprising (1) a first antigenic determinant binding domain (ADBD) that specifically binds to a first antigenic determinant (AD), (2) a transmembrane domain, and (3) an intracellular domain; and (ii) a genetic modification that eliminates the expression of at least one human CD45 AD on the engineered cell.

In some embodiments, the disclosure provides an engineered human immune effector cell comprising (a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and (b) a genetic modification that eliminates the expression of the first AD on the engineered cell, wherein the engineered cell does not express the first AD.

In some embodiments, the disclosure provides a method of killing a target cell comprising contacting the target cell with an engineered cell engineered human immune effector cell comprising (a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and (b) a genetic modification that eliminates the expression of the first AD on the engineered cell.

In some embodiments, the disclosure provides a method of directing an immune response to a target cell in a subject comprising administering to the subject in need thereof a therapeutically effective amount of an engineered cell engineered human immune effector cell comprising (a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and (b) a genetic modification that eliminates the expression of the first AD on the engineered cell.

In some embodiments, the disclosure provides a method of treating a proliferative disorder, cancer, autoimmune disease, infection, or allograft rejection in a subject comprising administering to the subject in need thereof a therapeutically effective amount of an engineered human immune effector cell comprising (a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and (b) a genetic modification that eliminates the expression of the first AD on the engineered cell.

In some embodiments, the disclosure provides a method of directing an immune response to a target cell in a subject comprising (a) administering to the subject in need thereof a therapeutically effective amount of an engineered human immune effector cell comprising (i) a chimeric antigen receptor (CAR), wherein the CAR comprises (1) two or more antigenic determinant binding domains (ADBD) comprising a first ADBD that bind to a first antigenic determinants (AD), (2) a transmembrane domain, and (3) an intracellular domain; and (ii) a genetic modification that eliminates the expression of the first AD on the engineered cell; and (b) administering to the subject a therapeutically effective amount of an Adapter comprising an AD recognized by the CAR and a second ADBD that is capable of binding a second AD on the target cell.

In some embodiments, the disclosure provides a engineered human immune effector cell comprising (a) a chimeric antigen receptor (CAR), wherein the CAR comprises (i) a first antigenic determinant binding domain (ADBD) that specifically binds to a first antigenic determinant (AD), (ii) a transmembrane domain, and (iii) an intracellular domain; and (b) a genetic modification that eliminates the expression of a second AD on the engineered cell, wherein the engineered cell used in combination with an Adapter is capable of directing an immune response to a cell expressing the second AD in an in vitro assay, wherein the Adapter comprises the first AD and a second ADBD that specifically binds to the second AD, and wherein the engineered cell does not express the second AD.

In some embodiments, the disclosure provides a method of directing an immune response to a target cell in a subject comprising administering to the subject in need thereof a therapeutically effective amount of an engineered human immune effector cell comprising (i) a chimeric antigen receptor (CAR), wherein the CAR comprises (1) a first antigenic determinant binding domain (ADBD) that specifically binds to a first antigenic determinant (AD), (2) a transmembrane domain, and (3) an intracellular domain; and (ii) a genetic modification that eliminates the expression of a second AD on the engineered cell; and (b) administering to the subject a therapeutically effective amount of an Adapter comprising the first AD recognized by the CAR and a second ADBD that is capable of binding the second AD, wherein the second AD is expressed on the target cell.

In some embodiments, the disclosure provides an engineered human immune effector cell comprising (a) a chimeric antigen receptor (CAR), wherein the CAR comprises (i) two or more antigenic determinant binding domains (ADBD) comprising a first ADBD that specifically binds to a first antigenic determinants (AD), (ii) a transmembrane domain, and (iii) an intracellular domain; and (b) a genetic modification that eliminates the expression of a second AD on the engineered cell, wherein the engineered cell used in combination with an Adapter is capable of directing an immune response to a cell expressing the second AD in an in vitro assay, wherein the Adapter comprises the first AD and a second ADBD that specifically binds to the second AD, and wherein the engineered cell does not express the second AD.

In some embodiments, the disclosure provides a method of directing an immune response to a target cell in a subject comprising (a) administering to the subject in need thereof a therapeutically effective amount of an engineered human immune effector cell comprising (i) a chimeric antigen receptor (CAR), wherein the CAR comprises (1) two or more antigenic determinant binding domains (ADBD) comprising a first ADBD that specifically binds to a first antigenic determinants (AD), (2) a transmembrane domain, and (3) an intracellular domain; and (ii) a genetic modification that eliminates the expression of a second AD on the engineered cell; and (b) administering to the subject a therapeutically effective amount of an Adapter comprising the first AD recognized by the CAR and a second ADBD that is capable of binding the second AD, wherein the second AD is expressed on the target cell.

In some embodiments, the disclosure provides:

[1.] A composition comprising:
   (a) a cell expressing a chimeric antigen receptor (CAR), wherein the CAR comprises (i) an antigenic determinant binding domain (ADBD) that binds to a first antigenic determinant (AD) on a target cell, (ii) a transmembrane domain, and (iii) an intracellular domain; and
   (b) an Adapter which comprises (i) said first AD and (ii) an ADBD that binds to a second AD on said target cell;

[2.] a composition comprising:
   (a) a cell expressing a chimeric antigen receptor (CAR), wherein the CAR comprises (i) an antigenic determinant binding domain (ADBD) that binds to a first antigenic determinant (AD) on a target cell, (ii) a transmembrane domain, and (iii) an intracellular domain; and
   (b) an Adapter which comprises (i) said first AD and (ii) an ADBD that binds to a second AD on a second target cell;

[3.] a composition comprising:
   (a) a cell expressing a chimeric antigen receptor (CAR), wherein the CAR comprises (i) an antigenic determinant binding domain (ADBD) that is an alternative scaffold binding domain (ASBD) that binds to a first antigenic determinant (AD), (ii) a transmembrane domain, and (iii) an intracellular domain; and
   (b) an Adapter which comprises (i) said first AD and (ii) an ADBD that binds to a second AD on a target cell;

[4.] a composition comprising:
  (a) a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
  (b) an Adapter which comprises (i) said first AD and (ii) an ADBD comprising an ASBD that binds to a second AD on a target cell;

[5.] a composition comprising:
  (a) a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
  (b) an Adapter which comprises (i) said first AD and (ii) a D domain that binds to a second AD on a target cell;

[6.] a composition comprising:
  (a) a cell expressing a chimeric antigen receptor (CAR), wherein the CAR comprises (i) a D domain that binds to a first antigenic determinant (AD), (ii) a transmembrane domain, and (iii) an intracellular domain; and
  (b) an Adapter which comprises (i) said first AD and (ii) an ADBD that binds to a second AD on a target cell;

[7.] a composition comprising:
  (a) a cell expressing a chimeric antigen receptor (CAR), wherein the CAR comprises (i) a first D domain that binds to a first antigenic determinant (AD), (ii) a transmembrane domain, and (iii) an intracellular domain; and
  (b) an Adapter which comprises (i) said first AD and (ii) a second D domain that binds to a second AD on a target cell;

[8.] the composition of any of [1]-[7], wherein CAR comprises a single-chain variable fragment (scFv) ADBD;

[9.] the composition of any of [1]-[7], wherein the CAR comprises an alternative scaffold binding domain (ASBD) ADBD;

[10.] the composition of [9], wherein the CAR comprises a D domain, and optionally wherein the CAR comprises a sequence selected from the group: SEQ ID NO: 17-26, and 27 or SEQ ID NO: 44-1078, and 1079;

[11.] the composition of any one of [1]-[10], wherein the CAR comprises 2 ADBDs;

[12.] the composition of [11], wherein the CAR comprises an ASBD and a scFv;

[13.] the composition of [11], wherein the CAR comprises a D domain and a scFv;

[14.] the composition of [11], wherein the CAR comprises 2 ASBDs;

[15.] the composition of [11], wherein the CAR comprises 2 D domains;

[16.] the composition of any of [1]-[15], wherein the CAR intracellular domain is a signaling domain;

[17.] the composition of [16], wherein the CAR intracellular domain comprises a primary signaling domain;

[18.] the composition of [16], wherein the CAR intracellular domain comprises a CD3 primary signaling domain;

[19.] the composition of [17] or [18], wherein the CAR intracellular domain further comprises a costimulatory signaling domain;

[20.] the composition of [19], wherein the CAR intracellular domain comprises a costimulatory signaling domain selected from: CD28, 41BB, CD27, and CD134;

[21.] the composition of [20], wherein the CAR intracellular domain comprises a 41BB costimulatory signaling domain;

[22.] the composition of any of [1]-[21], wherein the CAR binds to an antigen selected from: CD19, CD22, CD123, BCMA, CS1, HER2, TACI, BAFFR, and PDL1;

[23.] the composition of [22], wherein the CAR binds to BCMA, and optionally wherein the CAR comprises a sequence selected from the group: SEQ ID NO: 44-338, and 339;

[24.] the composition of [22], wherein the CAR binds to CD123, and optionally wherein the CAR comprises a sequence selected from the group: SEQ ID NO: 340-77 and 773;

[25.] the composition of [22], wherein the CAR binds to CD19, and optionally wherein the CAR comprises a sequence selected from the group: SEQ ID NO: 1030-1058, and 1059;

[26.] the composition of [22], wherein the CAR binds to CD22, and optionally wherein the CAR comprises a sequence selected from the group: SEQ ID NO: 1060-1068, and 1069;

[27.] the composition of [22], wherein the CAR binds to CS1, and optionally wherein the CAR comprises a sequence selected from the group: SEQ ID NO: 780-794, and 795;

[28.] the composition of [22], wherein the CAR binds to HER2, optionally wherein the CAR comprises a sequence selected from the group: SEQ ID NO: 800-839, and 840;

[29.] the composition of [22], wherein the CAR binds to PDL1, and optionally wherein the CAR comprises a sequence selected from the group: SEQ ID NO: 1010-1016, 1074-1078, and 1079;

[30.] the composition of any of [1]-[21], wherein the CAR binds to AFP p26, and optionally wherein the CAR comprises a sequence selected from the group: SEQ ID NO: 841-983, and 984;

[31.] the composition of any of [1]-[30], wherein the CAR comprises 2 ADBDs that bind to separate targets;

[32.] the composition of [31], wherein the CAR binds to CD19 and CD123;

[33.] the composition of [31], wherein the CAR binds to BCMA and CS1;

[34.] the composition of [31], wherein the CAR binds to CD22 and CD123;

[35.] the composition of [31], wherein the CAR binds to PDL1 and CD123;

[36.] the composition of [32], wherein the CAR comprises a first ASBD that binds to CD19 and a second ASBD that binds to CD123;

[37.] the composition of [36] wherein the CAR comprises a first D domain that binds to CD19 and a second D domain that binds to CD123;

[38.] the composition of [32], wherein the CAR comprises a D domain that binds to CD19 and a scFv that binds to CD123;

[39.] the composition of [33], wherein the CAR comprises a first ASBD that binds to BCMA and a second ASBD that binds to CS1;

[40.] the composition of [39] wherein the CAR comprises a first D domain that binds to BCMA and a second D domain that binds to CS1;

[41.] the composition of [33], wherein the CAR comprises a D domain that binds to CS1 and a scFv that binds to BCMA;

[42.] the composition of [39], wherein the CAR comprises a D domain that binds to BCMA and a scFv that binds to CS1;

[43.] the composition of [34], wherein the CAR comprises a first ASBD that binds to CD22 and a second ASBD that binds to CD123;

[44.] the composition of [43], wherein the CAR comprises a first D domain that binds to CD22 and a second D domain that binds to CD123;

[45.] the composition of [34], wherein the CAR comprises a D domain that binds to CD22 and a scFv that binds to CD123;

[46.] the composition of [35], wherein the CAR comprises a first ASBD that binds to PDL1 and a second ASBD that binds to CD123;

[47.] the composition of [46], wherein the CAR comprises a first D domain that binds to PDL1 and a second D domain that binds to CD123;

[48.] the composition of [35], wherein the CAR comprises a D domain that binds to PDL1 and a scFv that binds to CD123;

[49.] the composition of [32], wherein the CAR comprises an ASBD that binds to CD19 and a scFv that binds to CD123;

[50.] the composition of any of [1]-[49], wherein the Adapter comprises an AD of a tumor antigen, optionally wherein the tumor antigen is selected from the group: BCMA, CD123, CD19, CD22, CS1, HER2, TACI, BAFFR, and PDL1;

[51.] the composition of [1]-[50], wherein the Adapter comprises an AD that is an epitope of AFP p26 or AFP, and optionally comprises the amino acid residues of SEQ ID NO: 16 or 1117-1123-;

[52.] the composition of any of [1]-[51] wherein the Adapter comprises an ADBD that is a scFv;

[53.] the composition of any of [1]-[51], wherein the Adapter comprises an ADBD that is an ASBD;

[54.] the composition of [53], wherein the Adapter comprises a D domain, and optionally wherein the Adapter comprises a sequence selected from the group: SEQ ID NO: 17-26, and 27, or SEQ ID NO: 44-1078, and 1079;

[55.] the composition of any one of [1]-[54], wherein the Adapter comprises two ADBDs;

[56.] the composition of [55], wherein the two ADBDs (a) are the same, (b) bind to the same antigenic determinant, (c) bind to different ADs of the same antigen, or (d) bind to different antigens on the same cell, or (e) bind to different antigens on different cells;

[57.] the composition of [55] or [56], wherein the Adapter comprises two ASBDs;

[58.] the composition of any one of [55]-[57], wherein the Adapter comprises two D domains, and optionally wherein the Adapter comprises an amino acid sequence selected from the group: SEQ ID NO: 44-1079;

[59.] the composition of any one of [55] or [56], wherein the Adapter comprises an ADBD that is a scFv and an ADBD that is an ASBD;

[60.] the composition of [59], wherein the Adapter comprises an ADBD that is a scFv and an ADBD that is a D domain;

[61.] the composition of any of [1]-[60], wherein the Adapter comprises an ADBD that binds to a member selected from: BCMA, CD123, CD19, CD22, CS1, HER2, TACI, BAFFR, and PDL1;

[62.] the composition of [61], wherein the Adapter comprises an ADBD that binds to BCMA, and optionally wherein the ADBD comprises a sequence selected from the group: SEQ ID NO: 44-338, and 339;

[63.] the composition of [61], wherein the Adapter comprises an ADBD that binds to CS1, and optionally wherein the ADBD comprises a sequence selected from the group: SEQ ID NO: 780-794, and 795;

[64.] the composition of [61], wherein the Adapter comprises an ADBD that binds to CD123, and optionally wherein the ADBD comprises a sequence selected from the group: SEQ ID NO: 340-772 and 773;

[65.] the composition of [61], wherein the Adapter comprises an ADBD that binds to CD19, and optionally wherein the ADBD comprises a sequence selected from the group: SEQ ID NO: 1030-1058, and 1059;

[66.] the composition of [61], wherein the Adapter comprises an ADBD that binds to binds to CD22, and optionally wherein the ADBD comprises a sequence selected from the group: SEQ ID NO: 1060-1068, and 1069;

[67.] the composition of [61], wherein the Adapter comprises an ADBD that binds to binds to binds to HER2, and optionally wherein the ADBD comprises a sequence selected from the group: SEQ ID NO: 800-839, and 840;

[68.] the composition of [61], wherein the Adapter comprises an ADBD that binds to TACI or BAFFR;

[69.] the composition of [61], wherein the Adapter comprises an ADBD that binds to PDL1, and optionally wherein the ADBD comprises a sequence selected from the group: SEQ ID NO: 1010-1016, 1074-1078, and 1079;

[70.] the composition of any of [1]-[69], wherein the Adapter is bispecific;

[71.] the composition of [70], wherein the Adapter comprises an ADBD that binds to CD19 and an ADBD that binds to CD123;

[72.] the composition of [70], wherein the Adapter comprises an ADBD that binds to BCMA and an ADBD that binds to CS1;

[73.] the composition of [70], wherein the Adapter comprises an ADBD that binds to CD22 and an ADBD that binds to CD123;

[74.] the composition of [70], wherein the Adapter comprises an ADBD that binds to PDL1 and an ADBD that binds to CD123;

[75.] the composition of any of [1]-[74], wherein the target cell is a tumor cell;

[76.] the composition of [75], wherein the tumor cell is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, myelodysplasia, breast cancer, and ovarian cancer;

[77.] the composition of [75], wherein the tumor cell is multiple myeloma;

[78.] the composition of [75], wherein at least one target cell is a tumor cell;

[79.] the composition of [75], wherein the first and second target cells are tumor cells;

[80.] the composition of [79], wherein the first and second tumor cells are of the same type;

[81.] the composition of [79], wherein the first and second tumor cells are of a different type;

[82.] the composition of [80] or [81], wherein the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, myelodysplasia, breast cancer, and ovarian cancer;

[83.] the composition of [82], wherein the tumor cells are multiple myeloma;

[84.] the composition of any of [1]-[83], wherein the cell expressing the CAR is an immune effector cell;

[85.] the composition of [84], wherein the immune effector cell is a T cell;

[86.] the composition of [84], wherein the immune effector cell is an NK cell;

[87.] the composition of any of [1]-[86], wherein the cell expressing the CAR kills the target cell;

[88.] the composition of any of [1]-[87], wherein binding of the Adapter to an antigenic determinant blocks the activity of the antigen comprising the AD;

[89.] a method of killing a target cell comprising contacting the target cell with the composition of any one of [1]-[88];

[90.] a method of killing a target cell comprising contacting a composition comprising a target cell with an Adapter, wherein
  (a) the composition comprising the target cell further comprises a cell expressing a CAR], wherein the CAR comprises (i) an antigenic determinant binding domain (ADBD) that binds to a first AD on said target cell, (ii) a transmembrane domain, and (iii) an intracellular domain; and
  (b) the Adapter comprises (i) said first AD and (ii) an ADBD that binds to a second AD on said target cell;

[91.] a method of killing one or more target cells comprising contacting a composition comprising a first target cell with an Adapter, wherein
  (a) the composition comprising the target cell further comprises a cell expressing a chimeric antigen receptor (CAR), wherein the CAR comprises (i) an antigenic determinant binding domain (ADBD) that binds to a first AD on said first target cell, (ii) a transmembrane domain, and (iii) an intracellular domain; and
  (b) the Adapter comprises (i) said first AD and (ii) an ADBD that binds to a second AD on a second target cell;

[92.] a method of killing a target cell comprising contacting a composition comprising a target cell with an Adapter, wherein
  (a) the composition comprising the target cell further comprises a cell expressing a chimeric antigen receptor (CAR), wherein the CAR comprises (i) an antigenic determinant binding domain (ADBD) that is an ASBD that binds to a first AD, (ii) a transmembrane domain, and (iii) an intracellular domain; and
  (b) the Adapter comprises (i) said first AD and (ii) an ADBD that binds to a second AD on said target cell;

[93.] a method of killing a target cell comprising contacting a composition comprising a target cell with an Adapter, wherein
  (a) the composition comprising the target cell further comprises a cell expressing a chimeric antigen receptor (CAR), wherein the CAR comprises (i) an antigenic determinant binding domain (ADBD) that binds to a first AD, (ii) a transmembrane domain, and (iii) an intracellular domain; and
  (b) the Adapter comprises (i) said first AD and (ii) an ADBD that is an ASBD that binds to a second AD on said target cell;

[94.] a method of killing a target cell comprising contacting a composition comprising a target cell with a cell expressing a chimeric antigen receptor (CAR), wherein
  (a) a first antigenic determinant (AD) is present on the target cell;
  (b) the composition comprising the first target cell further comprises an Adapter comprising (i) said first AD and (ii) an antigenic determinant binding domain (ADBD) that binds to a second AD on the target cell; and
  (c) the CAR comprises (i) an ADBD that binds to said first AD on the target cell or the Adapter, (ii) a transmembrane domain, and (iii) an intracellular domain;

[95.] a method of killing one or more target cells comprising contacting a composition comprising a target cell with a cell expressing a chimeric antigen receptor (CAR), wherein
  (a) a first AD is present on the first target cell;
  (b) the composition comprising the first target cell further comprises a second target cell and an Adapter comprising (i) said first AD and (ii) an antigenic determinant binding domain (ADBD) that binds to a second AD on a second target cell; and
  (c) the CAR comprises (i) an ADBD that binds to said first AD on the first target cell or the Adapter, (ii) a transmembrane domain, and (iii) an intracellular domain;

[96.] a method of killing a target cell comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that binds to said first AD on said target cell and (ii) a second AD; and
  (c) the CAR comprises (i) an ADBD that is an ASBD that binds to said second AD, (ii) a transmembrane domain, and (iii) an intracellular domain;

[97.] a method of killing a target cell comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;

[98.] a method of delivering an immune response to a target cell comprising contacting a composition comprising a target cell with an Adapter, wherein
  (a) the composition comprising the target cell further comprises a cell expressing a CAR], wherein the CAR comprises (i) an antigenic determinant binding domain (ADBD) that binds to a first AD on said target cell, (ii) a transmembrane domain, and (iii) an intracellular domain; and
  (b) the Adapter comprises (i) said first AD and (ii) an ADBD that binds to a second AD on said target cell;

[99.] a method of delivering an immune response to one or more target cells comprising contacting a composition comprising a first target cell with an Adapter, wherein
  (a) the composition comprising the target cell further comprises a cell expressing a chimeric antigen receptor (CAR), wherein the CAR comprises (i) an antigenic determinant binding domain (ADBD) that binds to a first AD on said first target cell, (ii) a transmembrane domain, and (iii) an intracellular domain; and
  (b) the Adapter comprises (i) said first AD and (ii) an ADBD that binds to a second AD on a second target cell;

[100.] a method of delivering an immune response to a target cell comprising contacting a composition comprising a target cell with an Adapter, wherein
  (a) the composition comprising the target cell further comprises a cell expressing a chimeric antigen receptor (CAR), wherein the CAR comprises (i) an antigenic determinant binding domain (ADBD) that is an ASBD that binds to a first AD, (ii) a transmembrane domain, and (iii) an intracellular domain; and
  (b) the Adapter comprises (i) said first AD and (ii) an ADBD that binds to a second AD on said target cell;
[101.] a method of delivering an immune response to a target cell comprising contacting a composition comprising a target cell with an Adapter, wherein
  (a) the composition comprising the target cell further comprises a cell expressing a chimeric antigen receptor (CAR), wherein the CAR comprises (i) an antigenic determinant binding domain (ADBD) that binds to a first AD, (ii) a transmembrane domain, and (iii) an intracellular domain; and
  (b) the Adapter comprises (i) said first AD and (ii) an ADBD that is an ASBD that binds to a second AD on said target cell;
[102.] a method of delivering an immune response to a target cell comprising contacting a composition comprising a target cell with a cell expressing a chimeric antigen receptor (CAR), wherein
  (a) a first antigenic determinant (AD) is present on the target cell;
  (b) the composition comprising the first target cell further comprises an Adapter comprising (i) said first AD and (ii) an antigenic determinant binding domain (ADBD) that binds to a second AD on the target cell; and
  (c) the CAR comprises (i) an ADBD that binds to said first AD on the target cell or the Adapter, (ii) a transmembrane domain, and (iii) an intracellular domain.
[103.] a method of delivering an immune response to one or more target cells comprising contacting a composition comprising a target cell with a cell expressing a chimeric antigen receptor (CAR), wherein
  (a) a first AD is present on the first target cell;
  (b) the composition comprising the first target cell further comprises a second target cell and an Adapter comprising (i) said first AD and (ii) an antigenic determinant binding domain (ADBD) that binds to a second AD on a second target cell; and
  (c) the CAR comprises (i) an ADBD that binds to said first AD on the first target cell or the Adapter, (ii) a transmembrane domain, and (iii) an intracellular domain;
[104.] a method of delivering an immune response to a target cell comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that binds to said first AD on said target cell and (ii) a second AD; and
  (c) the CAR comprises (i) an ADBD that is an ASBD that binds to said second AD, (ii) a transmembrane domain, and (iii) an intracellular domain;
[105.] a method of delivering an immune response to a target cell comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;
[106.] a method of killing a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and
  (b) the Adapter comprises (i) said first AD and (ii) an ADBD that binds to a second AD on said target cell;
[107.] a method of redirecting target cell killing in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on a first target cell, (ii) a transmembrane domain, and (iii) an intracellular domain; and
  (b) the Adapter comprises (i) said first AD and (ii) an ADBD that binds to a second AD on a second target cell;
[108.] a method of killing a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and
  (b) the Adapter comprises (i) said first AD and (ii) an ADBD that binds to a second AD on said target cell;
[109.] a method of killing a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
  (b) the Adapter comprises (i) said first AD and (ii) an ADBD that is an ASBD that binds to a second AD on said target cell;
[110.] a method of killing a target cell in a patient comprising administering a cell expressing a chimeric antigen receptor (CAR) to the patient, wherein
  (a) a first antigenic determinant (AD) and a second AD is present on the target cell;
  (b) the patient has been treated with an Adapter comprising (i) said first AD and (ii) an antigenic determinant binding domain (ADBD) that binds to said second AD on said target cell; and
  (c) the CAR comprises (i) an ADBD that binds to said first AD on the target cell or the Adapter, (ii) a transmembrane domain, and (iii) an intracellular domain;

[111.] a method of directing target cell killing in a patient comprising administering a cell expressing a chimeric antigen receptor (CAR) to the patient, wherein
  (a) the patient has been treated with an Adapter comprising (i) a first antigenic determinant (AD) and (ii) an antigenic determinant binding domain (ADBD) that binds to a second AD on the target cell; and
  (b) the CAR comprises (i) an ADBD that binds to said first AD on the Adapter, (ii) a transmembrane domain, and (iii) an intracellular domain;

[112.] a method of killing a target cell in a patient comprising administering a cell expressing a chimeric antigen receptor (CAR) to the patient, wherein
  (a) a first antigenic determinant (AD) is present on the target cell;
  (b) the patient has been treated with an Adapter comprising (i) an antigenic determinant binding domain (ADBD) that binds to said first AD on said target cell and (ii) a second AD; and
  (c) the CAR comprises (i) an ADBD that is an ASBD that binds to said second AD, (ii) a transmembrane domain, and (iii) an intracellular domain;

[113.] a method of killing a target cell in a patient comprising administering a cell expressing a chimeric antigen receptor (CAR) to the patient, wherein
  (a) a first antigenic determinant (AD) is present on the target cell;
  (b) the patient has been treated with a an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;

[114.] a method of delivering an immune response to a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and
  (b) the Adapter comprises (i) said first AD and (ii) an ADBD that binds to a second AD on said target cell;

[115.] a method of redirecting an immune response to a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on a first target cell, (ii) a transmembrane domain, and (iii) an intracellular domain; and
  (b) the Adapter comprises (i) said first AD and (ii) an ADBD that binds to a second AD on a second target cell;

[116.] a method of delivering an immune response to a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and
  (b) the Adapter comprises (i) said first AD and (ii) an ADBD that binds to a second AD on said target cell;

[117.] a method of delivering an immune response to a target cell in a patient comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
  (b) the Adapter comprises (i) said first AD and (ii) an ADBD that is an ASBD that binds to a second AD on said target cell;

[118.] a method of delivering an immune response to a target cell in a patient comprising administering a cell expressing a chimeric antigen receptor (CAR) to the patient, wherein
  (a) a first antigenic determinant (AD) and a second AD is present on the target cell;
  (b) the patient has been treated with an Adapter comprising (i) said first AD and (ii) an antigenic determinant binding domain (ADBD) that binds to said second AD on said target cell; and
  (c) the CAR comprises (i) an ADBD that binds to said first AD on the target cell or the Adapter, (ii) a transmembrane domain, and (iii) an intracellular domain;

[119.] a method of directing an immune response to a target cell in a patient comprising administering a cell expressing a chimeric antigen receptor (CAR) to the patient, wherein
  (a) the patient has been treated with an Adapter comprising (i) a first antigenic determinant (AD) and (ii) an antigenic determinant binding domain (ADBD) that binds to a second AD on the target cell; and
  (b) the CAR comprises (i) an ADBD that binds to said first AD on the Adapter, (ii) a transmembrane domain, and (iii) an intracellular domain;

[120.] a method of delivering an immune response to a target cell in a patient comprising administering a cell expressing a chimeric antigen receptor (CAR) to the patient, wherein
  (a) a first antigenic determinant (AD) is present on the target cell;
  (b) the patient has been treated with an Adapter comprising (i) an antigenic determinant binding domain (ADBD) that binds to said first AD on said target cell and (ii) a second AD; and
  (c) the CAR comprises (i) an ADBD that is an ASBD that binds to said second AD, (ii) a transmembrane domain, and (iii) an intracellular domain;

[121.] a method of delivering an immune response to a target cell in a patient comprising administering a cell expressing a chimeric antigen receptor (CAR) to the patient, wherein
  (a) a first antigenic determinant (AD) is present on the target cell;
  (b) the patient has been treated with a an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;

[122.] a method of treating proliferative disorder, cancer, autoimmune disease, infection, or allograft rejection comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;
[123.] a method of treating proliferative disorder, cancer, autoimmune disease, infection, or allograft rejection comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and
  (b) the Adapter comprises (i) said first AD and (ii) an ADBD that binds to a second AD on said target cell;
[124.] a method of redirecting treatment of a proliferative disorder, cancer, autoimmune disease, infection, or allograft rejection comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD) on a first target cell, (ii) a transmembrane domain, and (iii) an intracellular domain; and
  (b) the Adapter comprises (i) said first AD and (ii) an ADBD that binds to a second AD on a second target cell;
[125.] a method of treating proliferative disorder, cancer, autoimmune disease, infection, or allograft rejection comprising administering an Adapter to the patient, wherein
  (a) the patient has been treated with a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and
  (b) the Adapter comprises (i) said first AD and (ii) an ADBD that binds to a second AD on said target cell;
[126.] a method of treating proliferative disorder, cancer, autoimmune disease, infection, or allograft rejection comprising administering an Adapter to the patient, wherein
  (a) the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
  (b) the Adapter comprises (i) said first AD and (ii) an ADBD that is an ASBD that binds to a second AD on said target cell;
[127.] a method of treating proliferative disorder, cancer, autoimmune disease, infection, or allograft rejection comprising administering a cell expressing a chimeric antigen receptor (CAR) to the patient, wherein
  (a) a first antigenic determinant (AD) and a second AD is present on the target cell;
  (b) the patient has been treated with an Adapter comprising (i) said first AD and (ii) an antigenic determinant binding domain (ADBD) that binds to said second AD on said target cell; and
  (c) the CAR comprises (i) an ADBD that binds to said first AD on the target cell or the Adapter, (ii) a transmembrane domain, and (iii) an intracellular domain;
[128.] a method of directing treatment of a proliferative disorder, cancer, autoimmune disease, infection, or allograft rejection comprising administering a cell expressing a chimeric antigen receptor (CAR) to the patient, wherein
  (a) the patient has been treated with an Adapter comprising (i) a first antigenic determinant (AD) and (ii) an antigenic determinant binding domain (ADBD) that binds to a second AD on the target cell; and
  (b) the CAR comprises (i) an ADBD that binds to said first AD on the Adapter, (ii) a transmembrane domain, and (iii) an intracellular domain;
[129.] a method of treating proliferative disorder, cancer, autoimmune disease, infection, or allograft rejection comprising administering a cell expressing a chimeric antigen receptor (CAR) to the patient, wherein
  (a) a first antigenic determinant (AD) is present on the target cell;
  (b) the patient has been treated with an Adapter comprising (i) an antigenic determinant binding domain (ADBD) that binds to said first AD on said target cell and (ii) a second AD; and
  (c) the CAR comprises (i) an ADBD that is an ASBD that binds to said second AD, (ii) a transmembrane domain, and (iii) an intracellular domain;
[130.] a method of treating a proliferative disorder, cancer, autoimmune disease, infection, or allograft rejection comprising administering a cell expressing a chimeric antigen receptor (CAR) to the patient, wherein
  (a) a first antigenic determinant (AD) is present on the target cell;
  (b) the patient has been treated with a an Adapter comprising (i) an antigenic determinant binding domain (ADBD) that is an ASBD that binds to said first AD on said target cell and (ii) a second AD; and
  (c) the CAR comprises (i) an ADBD that binds to said second AD, (ii) a transmembrane domain, and (iii) an intracellular domain;
[131.] the method of any one of [122]-[130], wherein the proliferative disorder or cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, myelodysplasia, breast cancer, and ovarian cancer;
[132.] the method of any one of [122]-[130], wherein the proliferative disorder or cancer is multiple myeloma;
[133.] a method of treating hematological cancer comprising contacting a composition comprising a target cell with a cell expressing a chimeric antigen receptor (CAR), wherein
  (a) a first antigenic determinant (AD) is present on the target cell;
  (b) the composition comprising the target cell further comprises an Adapter comprising (i) an antigenic determinant binding domain (ADBD) that is an ASBD that binds to said first AD on said target cell and (ii) a second AD; and (c) the CAR comprises (i) an ADBD that binds to said second AD, (ii) a transmembrane domain, and (iii) an intracellular domain;

[134.] a method of treating hematological cancer comprising administering an Adapter to the patient, wherein
(a) the patient has been treated with a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and
(b) the Adapter comprises (i) said first AD and (ii) an ADBD that binds to a second AD on said target cell;

[135.] a method of redirecting treatment of a hematological cancer comprising administering an Adapter to the patient, wherein
(a) the patient has been treated with a cell expressing a chimeric antigen receptor (CAR), wherein the CAR comprises (i) an antigenic determinant binding domain (ADBD) that binds to a first antigenic determinant (AD) on a first target cell, (ii) a transmembrane domain, and (iii) an intracellular domain; and
(b) the Adapter comprises (i) said first AD and (ii) an ADBD that binds to a second AD on a second target cell;

[136.] a method of treating hematological cancer comprising administering an Adapter to the patient, wherein
(a) the patient has been treated with a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and
(b) the Adapter comprises (i) said first AD and (ii) an ADBD that binds to a second AD on said target cell;

[137.] a method of treating hematological cancer comprising administering an Adapter to the patient, wherein
(a) the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and
(b) the Adapter comprises (i) said first AD and (ii) an ADBD that is an ASBD that binds to a second AD on said target cell;

[138.] a method of treating hematological cancer comprising administering a cell expressing a chimeric antigen receptor (CAR) to the patient, wherein
(a) a first antigenic determinant (AD) and a second AD is present on the target cell;
(b) the patient has been treated with an Adapter comprising (i) said first AD and (ii) an antigenic determinant binding domain (ADBD) that binds to said second AD on said target cell; and
(c) the CAR comprises (i) an ADBD that binds to said first AD on the target cell or the Adapter, (ii) a transmembrane domain, and (iii) an intracellular domain;

[139.] a method of directing treatment of a hematological cancer comprising administering a cell expressing a chimeric antigen receptor (CAR) to the patient, wherein
(a) the patient has been treated with an Adapter comprising (i) a first antigenic determinant (AD) and (ii) an antigenic determinant binding domain (ADBD) that binds to a second AD on the target cell; and
(b) the CAR comprises (i) an ADBD that binds to said first AD on the Adapter, (ii) a transmembrane domain, and (iii) an intracellular domain;

[140.] a method of treating hematological cancer comprising administering a cell expressing a chimeric antigen receptor (CAR) to the patient, wherein
(a) a first antigenic determinant (AD) is present on the target cell;
(b) the patient has been treated with an Adapter comprising (i) an antigenic determinant binding domain (ADBD) that binds to said first AD on said target cell and (ii) a second AD; and
(c) the CAR comprises (i) an ADBD that is an ASBD that binds to said second AD, (ii) a transmembrane domain, and (iii) an intracellular domain;

[141.] a method of treating hematological cancer comprising administering a cell expressing a chimeric antigen receptor (CAR) to the patient, wherein
(a) a first antigenic determinant (AD) is present on the target cell;
(b) the patient has been treated with a an Adapter comprising (i) an antigenic determinant binding domain (ADBD) that is an ASBD that binds to said first AD on said target cell and (ii) a second AD; and
(c) the CAR comprises (i) an ADBD that binds to said second AD, (ii) a transmembrane domain, and (iii) an intracellular domain;

[142.] the method of any one of [133]-[141], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;

[143.] the method of any one of [133]-[141], wherein the hematological cancer is multiple myeloma;

[144.] the method of any of [90]-[131], wherein CAR comprises a single-chain variable fragment (scFv) ADBD;

[145.] the method of any of [90]-[143], wherein the CAR comprises an alternative scaffold binding domain (ASBD) ADBD;

[146.] the method of [145], wherein the CAR comprises a D domain, and optionally wherein the CAR comprises a sequence selected from the group: SEQ ID NO: 17-26, and 27 or SEQ ID NO: 44-1078, and 1079;

[147.] the method of any one of [90]-[146], wherein the CAR comprises 2 ADBDs;

[148.] the method of [147], wherein the CAR comprises an ASBD and a scFv;

[149.] the method of [147], wherein the CAR comprises a D domain and a scFv;

[150.] the method of [147], wherein the CAR comprises 2 ASBDs;

[151.] the method of [147], wherein the CAR comprises 2 D domains;

[152.] the method of any one of [90]-[151], wherein the CAR intracellular domain is a signaling domain;

[153.] the method of [152], wherein the CAR intracellular domain comprises a primary signaling domain;

[154.] the method of [152], wherein the CAR intracellular domain comprises a CD3 primary signaling domain;

[155.] the method of [153] or [154], wherein the CAR intracellular domain further comprises a costimulatory signaling domain;

[156.] the method of [155], wherein the CAR intracellular domain comprises a costimulatory signaling domain selected from: CD28, 41BB, CD27, and CD134;

[157.] the method of [156], wherein the CAR intracellular domain comprises a 41BB costimulatory signaling domain;

[158.] the method of any one of [90]-[157], wherein the CAR binds to an antigen selected from: CD19, CD22, CD123, BCMA, CS1, HER2, TACI, BAFFR, and PDL1;

[159.] the method of [158], wherein the CAR binds to BCMA, and optionally wherein the CAR comprises a sequence selected from the group: SEQ ID NO: SEQ ID NO: 44-338, and 339;

[160.] the method of [158], wherein the CAR binds to CS1, and optionally wherein the CAR comprises a sequence selected from the group: SEQ ID NO: 780-794, and 795;

[161.] the method of [158], wherein the CAR binds to CD123, and optionally wherein the CAR comprises a sequence selected from the group: SEQ ID NO: 340-772 and 773;

[162.] the method of [158], wherein the CAR binds to CD19, and optionally wherein the CAR comprises a sequence selected from the group: SEQ ID NO: 1030-1058, and 1059;

[163.] the method of [158], wherein the CAR binds to CD22, and optionally wherein the CAR comprises a sequence selected from the group: SEQ ID NO: 1060-1068, and 1069;

[164.] the method of [158], wherein the CAR binds to binds to HER2, and optionally wherein the CAR comprises a sequence selected from the group: SEQ ID NO: 800-839, and 840;

[165.] the method of [158], wherein the CAR binds to PDL1, and optionally wherein the CAR comprises a sequence selected from the group: SEQ ID NO: 1010-1016, 1074-1078, and 1079;

[166.] the method of any one of [90]-[157], wherein the CAR binds to AFP p26, and optionally wherein the CAR comprises a sequence selected from the group: SEQ ID NO: 841-983, and 984;

[167.] the method of any one of [90]-[166], wherein the CAR comprises 2 ADBDs that bind to separate targets;

[168.] the method of [167], wherein the CAR binds to CD19 and CD123;

[169.] the method of [167], wherein the CAR binds to CD22 and CD123;

[170.] the method of [167], wherein the CAR binds to PDL1 and CD123;

[171.] the method of [167], wherein the CAR binds to CS1 and BCMA;

[172.] the method of [168], wherein the CAR comprises a first ASBD that binds to CD19 and a second ASBD that binds to C123;

[173.] the method of [172], wherein the CAR comprises a first D domain that binds to CD19 and a second D domain that binds to CD123;

[174.] the method of [168], wherein the CAR comprises a D domain that binds to CD19 and a scFv that binds to CD123;

[175.] the method of [169], wherein the CAR comprises a first ASBD that binds to CD22 and a second ASBD that binds to CD123;

[176.] the method of [175], wherein the CAR comprises a first D domain that binds to CD22 and a second D domain that binds to CD123;

[177.] the method of [169], wherein the CAR comprises a D domain that binds to CD22 and a scFv that binds to CD123;

[178.] the method of [170], wherein the CAR comprises a first ASBD that binds to PDL1 and a second ASBD that binds to CD123;

[179.] the method of [178], wherein the CAR comprises a first D domain that binds to PDL1 and a second D domain that binds to CD123;

[180.] the method of [170], wherein the CAR comprises a D domain that binds to PDL1 and a scFv that binds to CD123;

[181.] the method of [168], wherein the CAR comprises an ASBD that binds to CD19 and a scFv that binds to CD123;

[182.] the method of [171], wherein the CAR comprises a first ASBD that binds to BCMA and a second ASBD that binds to CS1;

[183.] the method of [182], wherein the CAR comprises a first D domain that binds to BCMA and a second D domain that binds to CS1;

[184.] the method of [171], wherein the CAR comprises a D domain that binds to BCMA and a scFv that binds to CS1;

[185.] the method of [171], wherein the CAR comprises a D domain that binds to CS1 and a scFv that binds to BCMA;

[186.] the method of any one of [90]-[185], wherein the Adapter comprises an AD of a tumor antigen, optionally wherein the tumor antigen is selected from the group: BCMA, CD123, CD19, CD22, CS1, HER2, TACI, BAFFR, and PDL1;

[187.] the method of [90]-[186], wherein the Adapter comprises an AD that is an epitope of AFP p26 or AFP, and optionally comprises the amino acid residues of SEQ ID NO: 16 or 1117-1123;

[188.] the method of any one of [90]-[187], wherein the Adapter comprises an ADBD that is a scFv;

[189.] the method of any one of [90]-[187], wherein the Adapter comprises an ADBD that is an ASBD;

[190.] the method of [189], wherein the Adapter comprises a D domain, and optionally wherein the Adapter comprises a sequence selected from the group: SEQ ID NO: 17-26, and 27, or SEQ ID NO: 44-1078, and 1079;

[191.] the method of any one of [90]-[190], wherein the Adapter comprises two ADBDs;

[192.] the method of [191], wherein the two ADBDs (a) are the same, (b) bind to the same antigenic determinant, (c) bind to different ADs of the same antigen, or (d) bind to different antigens on the same cell, or (e) bind to different antigens on different cells;

[193.] the method of [191] or [192], wherein the Adapter comprises two ASBDs;

[194.] the method of any one of [191], [192], or [193], wherein the Adapter comprises two D domains, and optionally wherein the Adapter comprises an amino acid sequence selected from the group: SEQ ID NO: 44-1079;

[195.] the method of [191] or [192], wherein the Adapter comprises an ADBD that is a scFv and an ADBD that is an ASBD;

[196.] the method of [195], wherein the Adapter comprises an ADBD that is a scFv and an ADBD that is a D domain;

[197.] the method of any one of [90]-[196], wherein the Adapter comprises an ADBD that binds to a member selected from: BCMA, CS1, HER2, CD123, CD19, CD22, TACI, BAFFR, and PDL1;

[198.] the method of [197], wherein the Adapter comprises an ADBD that binds to BCMA, and optionally wherein the ADBD comprises a sequence selected from the group: SEQ ID NO: 44-338, and 339;

[199.] the method of [197], wherein the Adapter comprises an ADBD that binds to CS1, and optionally wherein the ADBD comprises a sequence selected from the group: SEQ ID NO: 780-794, and 795;

[200.] the method of [197], wherein the Adapter comprises an ADBD that binds to CD123, and optionally wherein the ADBD comprises a sequence selected from the group: SEQ ID NO: 340-772, and 773;

[201.] the method of [197], wherein the Adapter comprises an ADBD that binds to CD19, and optionally wherein the ADBD comprises a sequence selected from the group: SEQ ID NO: 1030-1058, and 1059;

[202.] the method of [197], wherein the Adapter comprises an ADBD that binds to binds to CD22, and optionally wherein the ADBD comprises a sequence selected from the group: SEQ ID NO: 1060-1068, and 1069;

[203.] the method of [197], wherein the Adapter comprises an ADBD that binds to binds to HER2, and optionally wherein the ADBD comprises a sequence selected from the group: SEQ ID NO: 800-839, and 840;

[204.] the method of [197], wherein the Adapter comprises an ADBD that binds to TACI or BAFFR;

[205.] the method of [197], wherein the Adapter comprises an ADBD that binds to PDL1, and optionally wherein the ADBD comprises a sequence selected from the group: SEQ ID NO: 1010-1016, 1074-1078, and 1079;

[206.] the method of any one of [90]-[205], wherein the Adapter is bispecific;

[207.] the method of [206], wherein the Adapter comprises an ADBD that binds to BCMA and an ADBD that binds to CS1;

[208.] the method of [206], wherein the Adapter comprises an ADBD that binds to CD19 and an ADBD that binds to CD123;

[209.] the method of [206], wherein the Adapter comprises an ADBD that binds to CD22 and an ADBD that binds to CD123;

[210.] the method of [206], wherein the Adapter comprises an ADBD that binds to PDL1 and an ADBD that binds to CD123;

[211.] the method of any one of [90]-[210], wherein the target cell is a tumor cell;

[212.] the method of [211], wherein the tumor cell is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, myelodysplasia, breast cancer, and ovarian cancer;

[213.] the method of [211], wherein the tumor cell is multiple myeloma;

[214.] the method of [211], wherein at least one target cell is a tumor cell;

[215.] the method of [211], wherein the first and second target cells are tumor cells;

[216.] the method of [215], wherein the first and second tumor cells are of the same type;

[217.] the method of [215], wherein the first and second tumor cells are of a different type;

[218.] the method of [214] or [215], wherein the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, myelodysplasia, breast cancer, and ovarian cancer;

[219.] the method of [214] or [215], wherein the tumor cells are multiple myeloma;

[220.] the method of any one of [90]-[219], wherein the cell expressing the CAR is an immune effector cell;

[221.] the method of [220], wherein the immune effector cell is a T cell;

[222.] the method of [220], wherein the immune effector cell is an NK cell;

[223.] the method of any one of [90]-[222], wherein the cell expressing the CAR kills the target cell;

[224.] An engineered human immune effector cell comprising
(a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and
(b) a genetic modification that eliminates the expression of the human CD45 AD on the engineered cell,
wherein the engineered cell is capable of directing an immune response to a CD45 AD expressing cell in an in vitro assay, and wherein the engineered cell does not express the CD45 AD;

[225.] a method of killing a target cell comprising contacting the engineered cell according to [224] with the target cell], wherein the target cell expresses human CD45;

[226.] a method of delivering an immune response to a target cell comprising contacting the engineered cell according to [224] with the target cell], wherein the target cell expresses human CD45;

[227.] a method of directing an immune response to a target cell in a subject comprising administering to the subject in need thereof a therapeutically effective amount of the engineered cell according to [224];

[228.] a method of treating a proliferative disorder, cancer, autoimmune disease, infection, or allograft rejection in a subject comprising administering to the subject in need thereof a therapeutically effective amount of the engineered cell according to [224];

[229.] a method of depleting lymphocytes comprising administering to a subject in need thereof an effective amount of the engineered cell according to [224];

[230.] a method of depleting memory T cell comprising administering to a subject in need thereof an effective amount of the engineered cell according to [224];

[231.] a method of treating an autoimmune disease or disorder comprising administering to a subject in need thereof a therapeutically effective amount of the engineered cell according to [224];

[232.] a method of conditioning a subject for transplantation comprising administering to the subject in need thereof an effective amount of the engineered cell according to [224];

[233.] a method of treating a hematological cancer comprising administering to a subject in need thereof a therapeutically effective amount of the engineered cell according to [224];

[234.] An engineered human immune effector cell comprising
(a) a chimeric antigen receptor (CAR) comprising (1) a first antigenic determinant binding domain (ADBD) that specifically binds to a first antigenic determinant (AD), (2) a transmembrane domain, and (3) an intracellular domain; and (b) a genetic modification that eliminates the expression of at least one human CD45 AD on the engineered cell, wherein the first AD is not the at least one human CD45 AD], wherein the engineered cell used in combination with an Adapter is capable of directing an immune response to a CD45 AD expressing cell in an in vitro assay], wherein the Adapter comprises the first AD and a second ADBD that specifically binds to the at least one human CD45 AD, and wherein the engineered cell does not express the at least one human CD45 AD;

[235.] a method of killing a target cell comprising contacting the engineered cell according to [234] with an Adapter and the target cell], wherein the target cell expresses CD45, and wherein the Adapter comprises the first AD and a second ADBD that specifically binds to a human CD45 AD;

[236.] a method of delivering an immune response to a target cell comprising contacting the engineered cell according to [234] with an Adapter and the target cell], wherein the target cell expresses CD45, and wherein the Adapter comprises the first AD and a second ADBD that specifically binds to a human CD45 AD;

[237.] a method of treating hematological cancer comprising contacting the engineered cell according to with an Adapter and a cancer cell], wherein the cancer cell expresses CD45, and wherein the Adapter comprises the first AD and a second ADBD that specifically binds to a human CD45 AD;

[238.] a method of directing an immune response to a target cell in a subject comprising
(a) administering to the subject in need thereof a therapeutically effective amount of the engineered cell according to [234]; and
(b) administering to the subject a therapeutically effective amount of an Adapter comprising the first AD and a second ADBD that specifically binds to a human CD45 AD;

[239.] a method of directing an immune response to a target cell in a subject comprising administering to the subject in need thereof a therapeutically effective amount of the engineered cell according to [234], wherein the subject has been administered an Adapter comprising the first AD and a second ADBD that specifically binds to a human CD45 AD;

[240.] a method of directing an immune response to a target cell in a subject comprising administering to a subject in need thereof a therapeutically effective amount of an Adapter comprising the first AD and a second ADBD that specifically binds to a human CD45 AD], wherein the subject has been administered the engineered cell according to [234];

[241.] a method of treating a proliferative disorder, cancer, autoimmune disease, infection, or allograft rejection in a subject comprising
(a) administering to the subject in need thereof a therapeutically effective amount of the engineered cell according to [234]; and
(b) administering to the subject a therapeutically effective amount of an Adapter comprising the first AD and a second ADBD that specifically binds to a human CD45 AD;

[242.] a method of treating a proliferative disorder, cancer, autoimmune disease, infection, or allograft rejection in a subject comprising administering to the subject in need thereof a therapeutically effective amount of the engineered cell according to [234], wherein the subject has been administered an Adapter comprising the first AD and a second ADBD that specifically binds to a human CD45 AD;

[243.] a method of treating a proliferative disorder, cancer, autoimmune disease, infection, or allograft rejection in a subject comprising administering to a subject in need thereof a therapeutically effective amount of an Adapter comprising the first AD and a second ADBD that specifically binds to a human CD45 AD], wherein the subject has been administered the engineered cell according to [234];

[244.] a method of depleting lymphocytes comprising
(a) administering to a subject in need thereof a therapeutically effective amount of the engineered cell according to [234]; and
(b) administering to the subject a therapeutically effective amount of an Adapter comprising the first AD and a second ADBD that specifically binds to a human CD45 AD;

[245.] a method of depleting lymphocytes comprising administering to a subject in need thereof a therapeutically effective amount of the engineered cell according to [234], wherein the subject has been administered an Adapter comprising the first AD and a second ADBD that specifically binds to a human CD45 AD;

[246.] a method of depleting lymphocytes comprising administering to a subject in need thereof a therapeutically effective amount of an Adapter comprising the first AD and a second ADBD that specifically binds to a human CD45 AD], wherein the subject has been administered the engineered cell according to [234];

[247.] a method of depleting memory T cell comprising
(a) administering to a subject in need thereof a therapeutically effective amount of the engineered cell according to [234]; and
(b) administering to the subject a therapeutically effective amount of an Adapter comprising the first AD and a second ADBD that specifically binds to a human CD45 AD;

[248.] a method of depleting memory T cell comprising administering to a subject in need thereof a therapeutically effective amount of an Adapter comprising the first AD and a second ADBD that specifically binds to a human CD45 AD], wherein the subject has been administered the engineered cell according to [234];

[249.] a method of depleting memory T cell comprising administering to a subject in need thereof a therapeutically effective amount of an Adapter comprising the first AD and a second ADBD that specifically binds to a human CD45 AD], wherein the subject has been administered the engineered cell according to [234];

[250.] a method of treating an autoimmune disease or disorder comprising
(a) administering to a subject in need thereof a therapeutically effective amount of the engineered cell according to [234]; and
(b) administering to the subject a therapeutically effective amount of an Adapter comprising the first AD and a second ADBD that specifically binds to a human CD45 AD;

[251.] a method of treating an autoimmune disease or disorder comprising administering to a subject in need thereof a therapeutically effective amount of an Adapter comprising the first AD and a second ADBD that specifically binds to a human CD45 AD], wherein the subject has been administered the engineered cell according to [234];

[252.] a method of treating an autoimmune disease or disorder comprising administering to a subject in need thereof a therapeutically effective amount of an Adapter comprising the first AD and a second ADBD that specifically binds to a human CD45 AD], wherein the subject has been administered the engineered cell according to [234];

[253.] a method of conditioning a subject for transplantation comprising
  (a) administering to a subject in need thereof a therapeutically effective amount of the engineered cell according to [234]; and
  (b) administering to the subject a therapeutically effective amount of an Adapter comprising the first AD and a second ADBD that specifically binds to a human CD45 AD;

[254.] a method of conditioning a subject for transplantation comprising administering to a subject in need thereof a therapeutically effective amount of the engineered cell according to [234], wherein the subject has been administered an Adapter comprising the first AD and a second ADBD that specifically binds to a human CD45 AD;

[255.] a method of conditioning a subject for transplantation comprising administering to a subject in need thereof a therapeutically effective amount of an Adapter comprising the first AD and a second ADBD that specifically binds to a human CD45 AD], wherein the subject has been administered the engineered cell according to [234];

[256.] a method of treating a hematological cancer comprising
  (a) administering to a subject in need thereof a therapeutically effective amount of the engineered cell according to [234]; and
  (b) administering to the subject a therapeutically effective amount of an Adapter comprising the first AD and a second ADBD that specifically binds to a human CD45 AD;

[257.] a method of treating a hematological cancer comprising administering to a subject in need thereof a therapeutically effective amount of the engineered cell according to [234], wherein the subject has been administered an Adapter comprising the first AD and a second ADBD that specifically binds to a human CD45 AD;

[258.] a method of treating a hematological cancer comprising administering to a subject in need thereof a therapeutically effective amount of an Adapter comprising the first AD and a second ADBD that specifically binds to a human CD45 AD], wherein the subject has been administered the engineered cell according to [234];

[259.] An engineered human immune effector cell comprising:
  (a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and
  (b) a genetic modification that eliminates the expression of the first AD on the engineered cell,
  wherein the engineered cell does not express the first AD;

[260.] a method of killing a target cell comprising contacting the engineered cell according to [259] with the target cell;

[261.] a method of delivering an immune response to a target cell comprising contacting the engineered cell according to [259] with the target cell;

[262.] a method of directing an immune response to a target cell in a subject comprising administering to the subject in need thereof a therapeutically effective amount of the engineered cell according to [259];

[263.] a method of treating a proliferative disorder, cancer, autoimmune disease, infection, or allograft rejection in a subject comprising administering to the subject in need thereof a therapeutically effective amount of the engineered cell according to [259];

[264.] a method of depleting lymphocytes comprising administering to a subject in need thereof an effective amount of the engineered cell according to [259];

[265.] a method of conditioning a subject for transplantation comprising administering to the subject in need thereof an effective amount of the engineered cell according to [259];

[266.] a method of treating a hematological cancer comprising administering to a subject in need thereof a therapeutically effective amount of the engineered cell according to [259];

[267.] a method of killing a target cell comprising contacting the engineered cell according to [259] with an Adapter and the target cell], wherein the Adapter comprises an AD recognized by the CAR and a second ADBD;

[268.] a method of delivering an immune response to a target cell comprising contacting the engineered cell according to [259] with an Adapter and the target cell, and wherein the Adapter comprises an AD recognized by the CAR and a second ADBD that is capable of binding a second AD on the target cell;

[269.] a method of treating hematological cancer comprising contacting the engineered cell according to with an Adapter and a cancer cell], wherein the Adapter comprises an AD recognized by the CAR and a second ADBD that is capable of binding a second AD on the cancer cell;

[270.] a method of directing an immune response to a target cell in a subject comprising
  (a) administering to the subject in need thereof a therapeutically effective amount of the engineered cell according to [259]; and
  (b) administering to the subject a therapeutically effective amount of an Adapter comprising an AD recognized by the CAR and a second ADBD that is capable of binding a second AD on the target cell;

[271.] a method of directing an immune response to a target cell in a subject comprising administering to the subject in need thereof a therapeutically effective amount of the engineered cell according to [259], wherein the subject has been administered an Adapter comprising an AD recognized by the CAR and a second ADBD that is capable of binding a second AD on the target cell;

[272.] a method of directing an immune response to a target cell in a subject comprising administering to a subject in need thereof a therapeutically effective amount of an Adapter comprising an AD recognized by the CAR and a second ADBD that is capable of binding a second AD on the target cell], wherein the subject has been administered the engineered cell according to [259];

[273.] a method of treating a proliferative disorder, cancer, autoimmune disease, infection, or allograft rejection in a subject comprising
  (a) administering to the subject in need thereof a therapeutically effective amount of the engineered cell according to [259]; and
  (b) administering to the subject a therapeutically effective amount of an Adapter comprising an AD recognized by the CAR and a second ADBD that is capable of binding a second AD on a target cell;

[274.] a method of treating a proliferative disorder, cancer, autoimmune disease, infection, or allograft rejection in a subject comprising administering to the subject in need thereof a therapeutically effective amount of the engineered cell according to [259], wherein the subject has been administered an Adapter comprising an AD recognized by the CAR and a second ADBD that is capable of binding a second AD on a target cell;

[275.] a method of treating a proliferative disorder, cancer, autoimmune disease, infection, or allograft rejection in a subject comprising administering to a subject in need thereof a therapeutically effective amount of an Adapter comprising an AD recognized by the CAR and a second ADBD that is capable of binding a second AD on a target cell], wherein the subject has been administered the engineered cell according to [259];

[276.] a method of depleting lymphocytes comprising
 (a) administering to a subject in need thereof a therapeutically effective amount of the engineered cell according to [259]; and
 (b) administering to the subject a therapeutically effective amount of an Adapter comprising an AD recognized by the CAR and a second ADBD that is capable of binding a second AD on a target cell;

[277.] a method of depleting lymphocytes comprising administering to a subject in need thereof a therapeutically effective amount of the engineered cell according to [259], wherein the subject has been administered an Adapter comprising an AD recognized by the CAR and a second ADBD that is capable of binding a second AD on a target cell;

[278.] a method of depleting lymphocytes comprising administering to a subject in need thereof a therapeutically effective amount of an Adapter comprising an AD recognized by the CAR and a second ADBD that is capable of binding a second AD on a target cell], wherein the subject has been administered the engineered cell according to [259];

[279.] a method of conditioning a subject for transplantation comprising
 (a) administering to a subject in need thereof a therapeutically effective amount of the engineered cell according to [259]; and
 (b) administering to the subject a therapeutically effective amount of an Adapter comprising an AD recognized by the CAR and a second ADBD that is capable of binding a second AD on a target cell;

[280.] a method of conditioning a subject for transplantation comprising administering to a subject in need thereof a therapeutically effective amount of the engineered cell according to [259], wherein the subject has been administered an Adapter comprising an AD recognized by the CAR and a second ADBD that is capable of binding a second AD on a target cell;

[281.] a method of conditioning a subject for transplantation comprising administering to a subject in need thereof a therapeutically effective amount of an Adapter comprising an AD recognized by the CAR and a second ADBD that is capable of binding a second AD on a target cell], wherein the subject has been administered the engineered cell according to [259];

[282.] a method of treating a hematological cancer comprising
 (a) administering to a subject in need thereof a therapeutically effective amount of the engineered cell according to [259]; and
 (b) administering to the subject a therapeutically effective amount of an Adapter comprising an AD recognized by the CAR and a second ADBD that is capable of binding a second AD on a target cell;

[283.] a method of treating a hematological cancer comprising administering to a subject in need thereof a therapeutically effective amount of the engineered cell according to [259], wherein the subject has been administered an Adapter comprising an AD recognized by the CAR and a second ADBD that is capable of binding a second AD on a target cell;

[284.] a method of treating a hematological cancer comprising administering to a subject in need thereof a therapeutically effective amount of an Adapter comprising an AD recognized by the CAR and a second ADBD that is capable of binding a second AD on a target cell], wherein the subject has been administered the engineered cell according to [259];

[285.] An engineered human immune effector cell comprising:
 (a) a chimeric antigen receptor (CAR), wherein the CAR comprises (i) a first antigenic determinant binding domain (ADBD) that specifically binds to a first antigenic determinant (AD), (ii) a transmembrane domain, and (iii) an intracellular domain; and
 (b) a genetic modification that eliminates the expression of a second AD on the engineered cell, wherein the engineered cell used in combination with an Adapter is capable of directing an immune response to a cell expressing the second AD in an in vitro assay], wherein the Adapter comprises the first AD and a second ADBD that specifically binds to the second AD, and wherein the engineered cell does not express the second AD;

[286.] An engineered human immune effector cell comprising:
 (a) a chimeric antigen receptor (CAR), wherein the CAR comprises (i) two or more antigenic determinant binding domains (ADBD) comprising a first ADBD that specifically binds to a first antigenic determinants (AD), (ii) a transmembrane domain, and (iii) an intracellular domain; and
 (b) a genetic modification that eliminates the expression of a second AD on the engineered cell, wherein the engineered cell used in combination with an Adapter is capable of directing an immune response to a cell expressing the second AD in an in vitro assay], wherein the Adapter comprises the first AD and a second ADBD that specifically binds to the second AD, and wherein the engineered cell does not express the second AD;

[287.] a method of directing an immune response to a target cell in a subject comprising administering to the subject in need thereof a therapeutically effective amount of the engineered cell according to [285] or [286];

[288.] a method of treating a proliferative disorder, cancer, autoimmune disease, infection, or allograft rejection in a subject comprising administering to the subject in need thereof a therapeutically effective amount of the engineered cell according to [285] or [286];

[289.] a method of depleting lymphocytes comprising administering to a subject in need thereof an effective amount of the engineered cell according to [285] or [286];

[290.] a method of conditioning a subject for transplantation comprising administering to the subject in need thereof an effective amount of the engineered cell according to [285] or [286];

[291.] a method of treating a hematological cancer comprising administering to a subject in need thereof a therapeutically effective amount of the engineered cell according to [285] or [286];

[292.] a method of killing a target cell comprising contacting the engineered cell according to [285] or [286] with an Adapter and the target cell], wherein the Adapter comprises the first AD and a second ADBD that specifically binds to the second AD, and wherein the second AD is expressed on the target cell;

[293.] a method of delivering an immune response to a target cell comprising contacting the engineered cell according to [285] or [286] with an Adapter and the target cell], wherein the Adapter comprises the first AD and a second ADBD that specifically binds to the second AD, and wherein the second AD is expressed on the target cell;

[294.] a method of treating hematological cancer comprising contacting the engineered cell according to or [286] with an Adapter and a cancer cell], wherein the Adapter comprises the first AD and a second ADBD that specifically binds to the second AD, and wherein the second AD is expressed on the cancer cell;

[295.] a method of directing an immune response to a target cell in a subject comprising
(a) administering to the subject in need thereof a therapeutically effective amount of the engineered cell according to [285] or [286]; and
(b) administering to the subject a therapeutically effective amount of an Adapter comprising the first AD and a second ADBD that specifically binds to the second AD], wherein the second AD is expressed on the target cell;

[296.] a method of directing an immune response to a target cell in a subject comprising administering to the subject in need thereof a therapeutically effective amount of the engineered cell according to [285] or [286]], wherein the subject has been administered an Adapter comprising the first AD and a second ADBD that specifically binds to the second AD, and wherein the second AD is expressed on the target cell;

[297.] a method of directing an immune response to a target cell in a subject comprising administering to a subject in need thereof a therapeutically effective amount of an Adapter comprising the first AD and a second ADBD that specifically binds to the second AD], wherein the subject has been administered the engineered cell according to [285] or [286], and wherein the second AD is expressed on the target cell;

[298.] a method of treating a proliferative disorder, cancer, autoimmune disease, infection, or allograft rejection in a subject comprising
(a) administering to the subject in need thereof a therapeutically effective amount of the engineered cell according to [285] or [286]; and
(b) administering to the subject a therapeutically effective amount of an Adapter comprising the first AD and a second ADBD that specifically binds to the second AD], wherein the second AD is expressed on a target cell associated with the proliferative disorder, cancer, autoimmune disease, infection, or allograft rejection;

[299.] a method of treating a proliferative disorder, cancer, autoimmune disease, infection, or allograft rejection in a subject comprising administering to the subject in need thereof a therapeutically effective amount of the engineered cell according to [285] or [286]], wherein the subject has been administered an Adapter comprising the first AD and a second ADBD that specifically binds to the second AD, and wherein the second AD is expressed on a target cell associated with the proliferative disorder, cancer, autoimmune disease, infection, or allograft rejection;

[300.] a method of treating a proliferative disorder, cancer, autoimmune disease, infection, or allograft rejection in a subject comprising administering to a subject in need thereof a therapeutically effective amount of an Adapter comprising the first AD and a second ADBD that specifically binds to the second AD], wherein the subject has been administered the engineered cell according to [285] or [286], and wherein the second AD is expressed on a target cell associated with the proliferative disorder, cancer, autoimmune disease, infection, or allograft rejection;

[301.] a method of depleting lymphocytes comprising
(a) administering to a subject in need thereof a therapeutically effective amount of the engineered cell according to [285] or [286]; and
(b) administering to the subject a therapeutically effective amount of an Adapter comprising the first AD and a second ADBD that specifically binds to the second AD], wherein the second AD is expressed on a lymphocyte target cell;

[302.] a method of depleting lymphocytes comprising administering to a subject in need thereof a therapeutically effective amount of the engineered cell according to [285] or [286]], wherein the subject has been administered an Adapter comprising the first AD and a second ADBD that specifically binds to the second AD, and wherein the second AD is expressed on a lymphocyte target cell;

[303.] a method of depleting lymphocytes comprising administering to a subject in need thereof a therapeutically effective amount of an Adapter comprising the first AD and a second ADBD that specifically binds to the second AD], wherein the subject has been administered the engineered cell according to [285] or [286], and wherein the second AD is expressed on a lymphocyte target cell;

[304.] a method of conditioning a subject for transplantation comprising
(a) administering to a subject in need thereof a therapeutically effective amount of the engineered cell according to [285] or [286]; and
(b) administering to the subject a therapeutically effective amount of an Adapter comprising the first AD and a second ADBD that specifically binds to the second AD], wherein the second AD is expressed on a target cell associated with the transplantation;

[305.] a method of conditioning a subject for transplantation comprising administering to a subject in need thereof a therapeutically effective amount of the engineered cell according to [285] or [286]], wherein the subject has been administered an Adapter comprising the first AD and a second ADBD that specifically binds to the second AD, and wherein the second AD is expressed on a target cell associated with the transplantation;

[306.] a method of conditioning a subject for transplantation comprising administering to a subject in need thereof a therapeutically effective amount of an Adapter comprising the first AD and a second ADBD that specifically binds to the second AD], wherein the subject has been administered the engineered cell according to [285] or [286], and wherein the second AD is expressed on a target cell associated with the transplantation;

[307.] a method of treating a hematological cancer comprising
(a) administering to a subject in need thereof a therapeutically effective amount of the engineered cell according to [285] or [286]; and
(b) administering to the subject a therapeutically effective amount of an Adapter comprising the first AD and a second ADBD that specifically binds to the second AD], wherein the second AD is expressed on a target cell associated with the hematological cancer;

[308.] a method of treating a hematological cancer comprising administering to a subject in need thereof a therapeutically effective amount of the engineered cell according to [285] or [286]], wherein the subject has been administered an Adapter comprising the first AD and a second ADBD that specifically binds to the second AD, and wherein the second AD is expressed on a target cell associated with the hematological cancer;

[309.] a method of treating a hematological cancer comprising administering to a subject in need thereof a therapeutically effective amount of an Adapter comprising the first AD and a second ADBD that specifically binds to the second AD], wherein the subject has been administered the engineered cell according to [285] or [286], and wherein the second AD is expressed on a target cell associated with the hematological cancer;

[310.] an isolated Adapter polypeptide comprising (1) an antigenic determinant (AD) and (b) one or more antigenic determinant binding domain (ADBD),
wherein at least one ADBD specifically binds to a human CD45 AD, and wherein contacting the Adaptor with a CD45 AD expressing target cell in the presence of an engineered cell according to is capable of directing an immune response by the engineered cell to the target cell in an in vitro assay.

BRIEF DESCRIPTION OF THE DRAWINGS/FIGURES

Figure 1D:
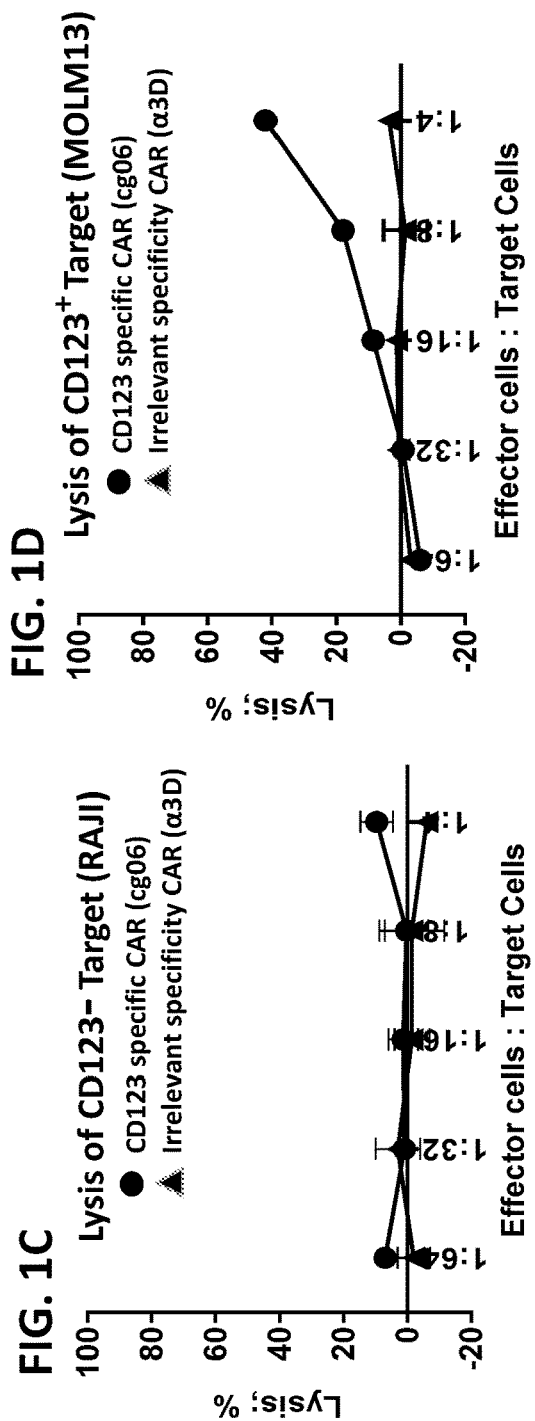

FIG. 1A-1D: The cytolytic activity of CD123-specific (cg06) and BCMA-specific (bc-40) CARs were compared to a CAR with no known target-specificity (α3D) on a panel of tumors using effector cell to target cell ratios ranging from 1:4 to 1:64. Briefly, 20,000 T cells expressing the bc40, cg06, or α3D CAR were incubated with increasing numbers of a CD123$^+$/BCMA$^-$ tumor target (MOLM13)(FIG. 1A); a CD123$^-$/BCMA$^+$ tumor target (H929)(FIG. 1B); a CD123$^-$ tumor target (RAJI)(FIG. 1C); or a CD123$^+$/BCMA$^-$ tumor target (MOLM13)(FIG. 1D). After 16 hours, cells were washed and luciferase activity was assessed.

Figure 2A:
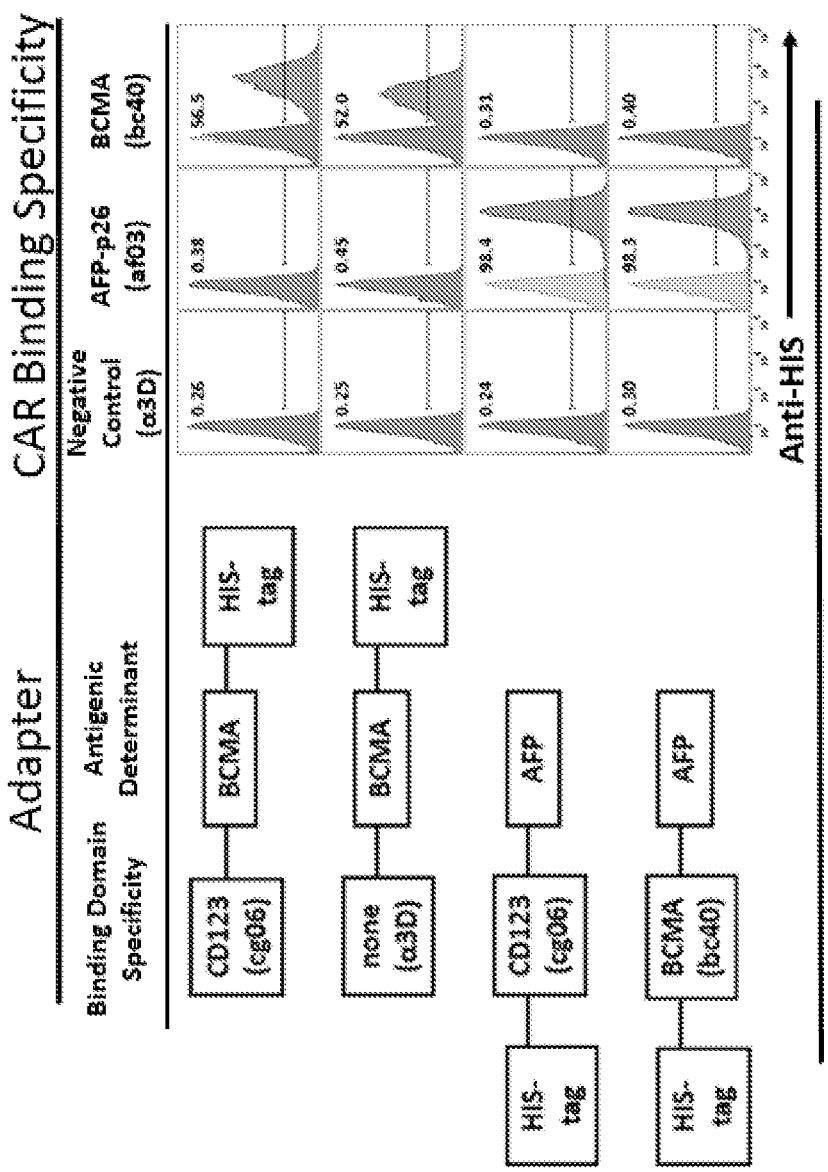
Figure 2B:
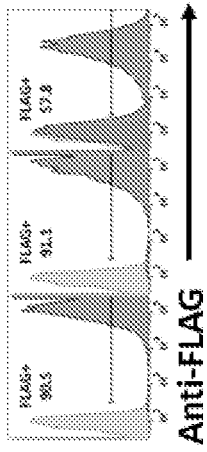

FIGS. 2A-2B: Adapter binding associates with the Adapter and CAR binding specificity. Jurkat NFAT-Luciferase reporter cells were transduced with a negative control CAR (α3D), an AFP (p26)-binding CAR (af03), or a BCMA-binding CAR (bc40). In FIG. 2A, CAR transduced Jurkat cells were incubated with 0.5 μg of Adapter protein (4° C. for 20 minutes), washed, and then stained with anti-HIS PE (clone J095G46, 4° C. for 20 minutes). FIG. 2B shows CAR expression based on FLAG staining (clone L5) versus mock transduced Jurkat cells.

Figure 3A:
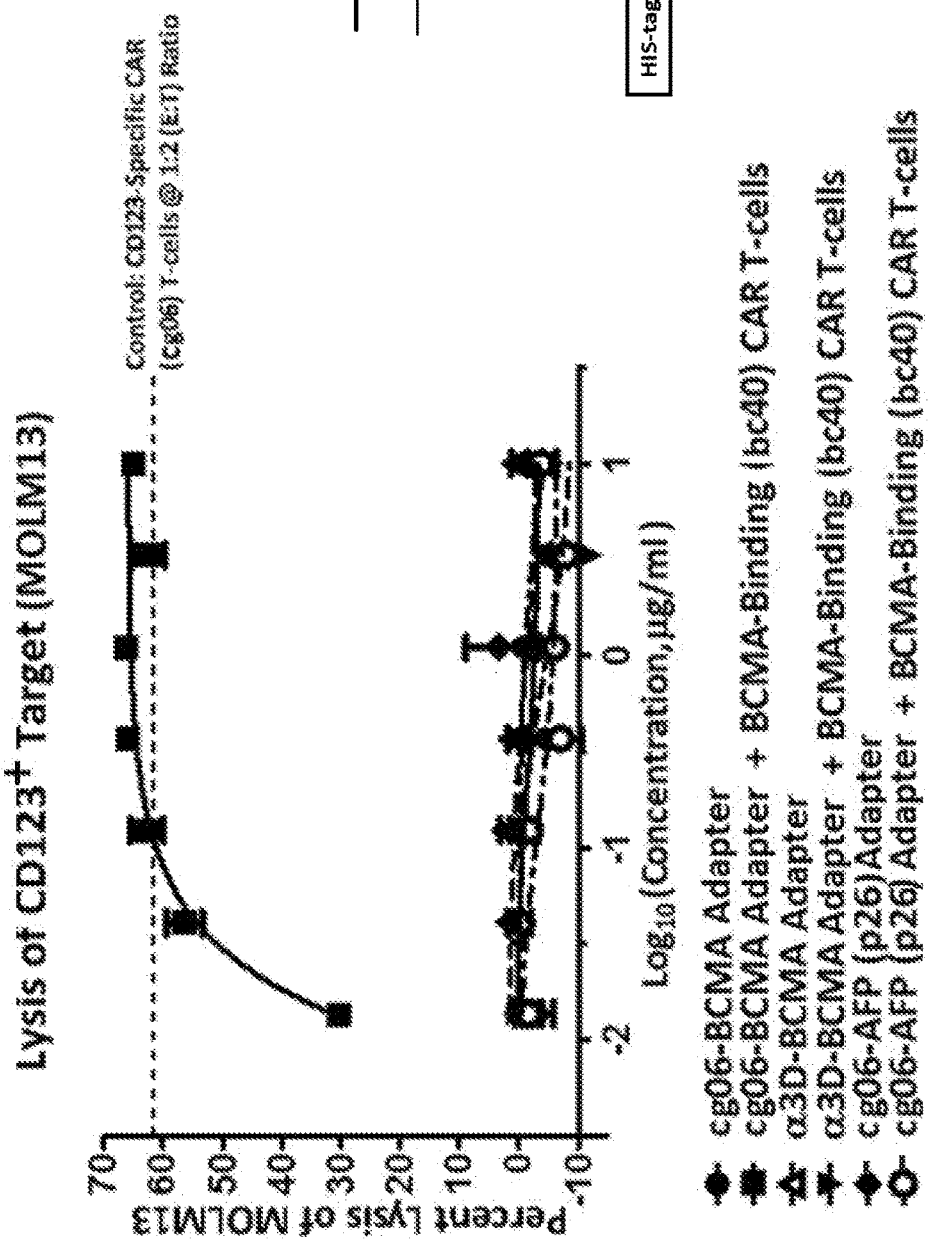

FIGS. 3A-3C show that the Adapter binding of matching CAR: Adapter and Target: Adapter specificity drives lysis of target cells. In FIG. 3A, 40,000 CD123$^+$BCMA$^-$ MOLM13-GFP/Luciferase cells were incubated with various Adapters in the presence or absence of 20,000 T cells (E:T ratio of 1:2, donor D14-053017, Day 7) transduced with BCMA-binding CAR (bc40) for 16 hours. After 16 hours, cells were washed and luciferase activity was assessed. Percent lysis was assessed based on wells of MOLM13-GFP/Luciferase cultured in the absence of T cells or Adapter protein. A control of CD123-specific CAR T cells (cg06) cultured at the same ratio was used as a positive control for lysis. In FIG. 3B, 40,000 CD123$^+$BCMA$^-$ MOLM13-GFP/Luciferase cells were incubated with CD123 (cg06)-AFP (p26) Adapter in the presence or absence of 20,000 T cells (E:T ratio of 1:2, donor D16-061317, Day 7) transduced with AFP-binding CARs (Af03 or Af05) for 16 hours. After 16 hours, cells were washed and luciferase activity was assessed. Percent lysis was assessed based on wells of MOLM13-GFP/Luciferase cultured in the absence of T cells or Adapter protein. A control of CD123-specific CART cells (cg06) cultured at the same ratio was used as a positive control for lysis. In FIG. 3C, 40,000 BCMA$^+$ NCI H929-GFP/Luciferase cells were incubated with bc40-AFP (p26) Adapter in the presence or absence of 10,000 T cells (E:T ratio of 1:4, donor D15-062017, Day 8) mock transduced or transduced with AFP-binding CARs (Af03 or Af05) for 16 hours. After 16 hours, cells were washed and luciferase activity was assessed. Percent lysis was assessed based on wells of NCI-H929-GFP/Luciferase cultured in the absence of T cells or Adapter protein.

FIGS. 4A-4D show that Adapter binding of matching CAR: Adapter and Target: Adapter specificity drives cytokine production by CAR T cells. In FIGS. 4A and 4B, donor D14-053017 T cells transduced with BCMA-binding CAR (bc40) were cultured overnight with various Adapters in the presence or absence of CD123$^+$BCMA$^-$ MOLM13 cells (25,000 T cells and target cells). Cultured supernatants were collected and assessed for the production of IL-2 (FIG. 4A) and IFN-γ (FIG. 4B). In FIGS. 4C and 4D, donor D15-062017 T cells transduced with AFP-binding CARs (Af03 and Af05) were cultured overnight with cg06-AFP (p26) Adapter in the presence or absence of CD123$^+$BCMA$^-$ MOLM13 cells (25,000 T cells and target cells). Cultured supernatants were collected and assessed for the production of IL-2 (FIG. 4C) and IFN-γ (FIG. 4D).

FIG. 5: Adapter binding of matching CAR: Adapter and Target: Adapter specificity drives proliferation of CAR T cells. Donor D16-062717 cells transduced with AFP-binding CAR (Af03) were CFSE labeled (10 minutes at 0.5 μM), then cultured (25,000) in the presence of CD123-specific Adapter or BCMA-specific Adapter in the presence or absence of mitomycin-C treated CD123$^-$ BCMA$^+$ NCI-H929 cells (25,000) for 72 hours. At 72 hours, cells were stained for CD3, then analyzed for absolute numbers of CD3$^+$ cells via flow cytometry.

FIGS. 6A and 6B show that Adapter binding of matching CAR: Adapter and Target: Adapter drives signaling by CAR-expressing Jurkat NFAT-Luciferase reporter cells. In FIG. 6A, 50,000 reporter cells previously transduced with a BCMA-binding CAR (bc40) were cultured for 5 hours in the presence of various Adapter proteins in the presence or absence of 50,000 CD123$^+$BCMA$^-$ MOLM14 cells, then assessed for luciferase activity. In FIG. 6B, 50,000 reporter cells previously transduced with an AFP (p26)-binding CAR (af03) were cultured for 5 hours in the presence of the a specific α3D-Adapter or the BCMA-specific Bc40-Adapter protein in the presence or absence of 50,000 BCMA$^+$ NCI-H929 cells, then assessed for luciferase activity.

FIGS. 7A and 7B show that the CD123-specific Adapter with a BCMA antigenic determinant can function with either a BCMA-specific D domain CAR (bc40) or a BCMA-specific scFv CAR (c11D5-3). In FIG. 7A, 40,000 CD123$^+$ BCMA$^-$ MOLM13-GFP/Luciferase cells were incubated with the Cg06-BCMA Adapter in the presence or absence of 20,000 T cells (E:T ratio of 1:2, donor D14-062717, Day 9) transduced with a non-specific CAR (α3D), the BCMA-binding D domain CAR (bc40), or the BCMA-binding scFv CAR (c11D5-3) for 16 hours. After 16 hours, cells were washed and luciferase activity was assessed. Percent lysis was assessed based on wells of MOLM13-GFP/Luciferase cultured in the absence of T cells or Adapter protein. Solid lines indicate calculated 3-parameter non-linear curves, while the dashed line for c11D5-3 is present for illustrative purposes only. In FIG. 7B, CD123$^+$BCMA$^-$ MOLM13-GFP/Luciferase cells were cultured in the same experiment as in FIG. 7A with transduced T cells in the absence of Adapter protein.

Figure 8A:
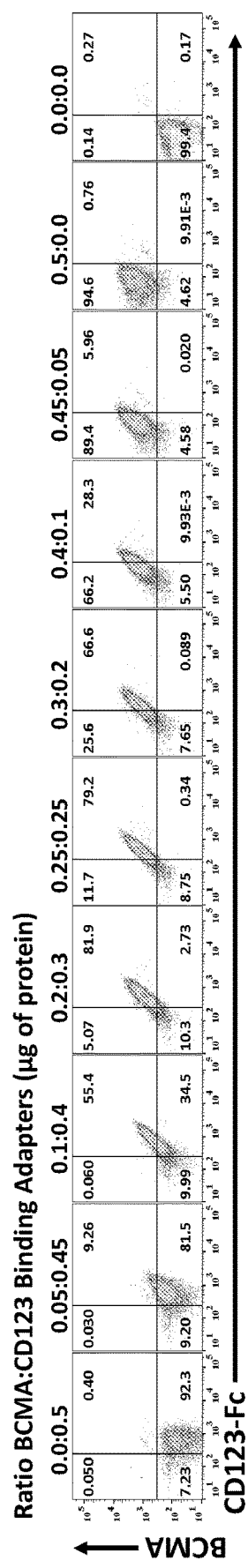
Figure 8B:
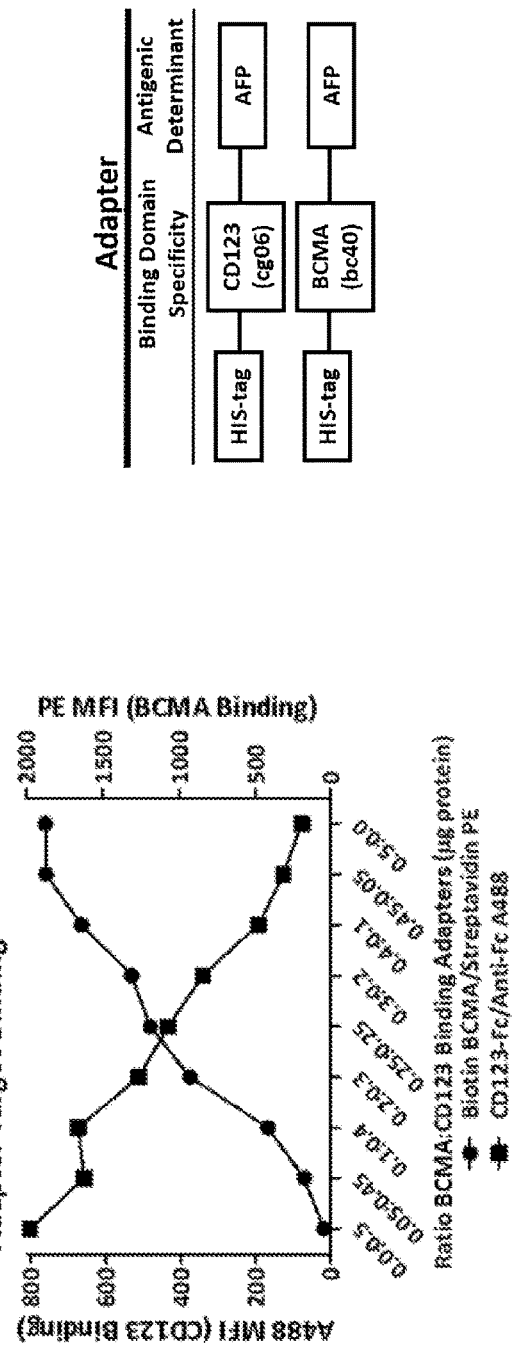

FIGS. 8A and 8B show that AFP-specific CARs can simultaneously have CD123 and BCMA-binding capacity via incubation with multiple Adapter proteins. $10^5$ Jurkat NFAT-Luciferase transduced with an AFP (p26)-binding CAR (af03) were incubated with a total of 0.5 μg of Adapter proteins at various ratios of the BCMA- to CD123-specific Adapters (4° C. for 20 minutes), washed, and then incubated with CD123-Fc and biotinylated BCMA (0.5 μg of each) (4° C. for 20 minutes), washed, then binding detected with Anti-Fc A488 and Streptavidin-PE. FIG. 8A presents a flow cytometric analysis of CD123-binding and BCMA-binding to their respective target proteins, FIG. 8B provides a comparison of mean fluorescence intensity (MFI) of A488 MFI (CD123-binding, left axis) and PE MFI (BCMA-binding, right axis) flow cytometric data presented in FIG. 8A.

FIGS. 9A and 9B show that dual-binding domain adaptor proteins drive enhanced signaling by CAR-expressing Jurkat NFAT-Luciferase reporter cells over single-binding domain adaptor proteins. In FIG. 9A, 50,000 reporter cells previously transduced with an AFP (p26 domain)-binding CAR (af03) were cultured for 5 hours in the presence of the CD123-specific Cg06-adaptor (Cg06-p26) or the Cg06-dual adaptor protein (Cg06-p26-Cg06 in the presence of 50,000 CD123$^-$ MOLM13 or CD123-deficient MOLM13 cells, then assessed for luciferase activity. CD123 deficient cells were generated using CRISPR/Cas9 genetic engineering technology. In FIG. 9B, 50,000 reporter cells previously transduced with an AFP (p26 domain)-binding CAR (af03) were cultured for 5 hours in the presence of the BCMA-specific Bc40-adaptor (Bc40-p26) or the Bc40-dual adaptor protein (Bc40-p26-Bc40) in the presence or absence of 50,000 BCMA$^+$ U266 cells, then assessed for luciferase activity.

Figure 10:
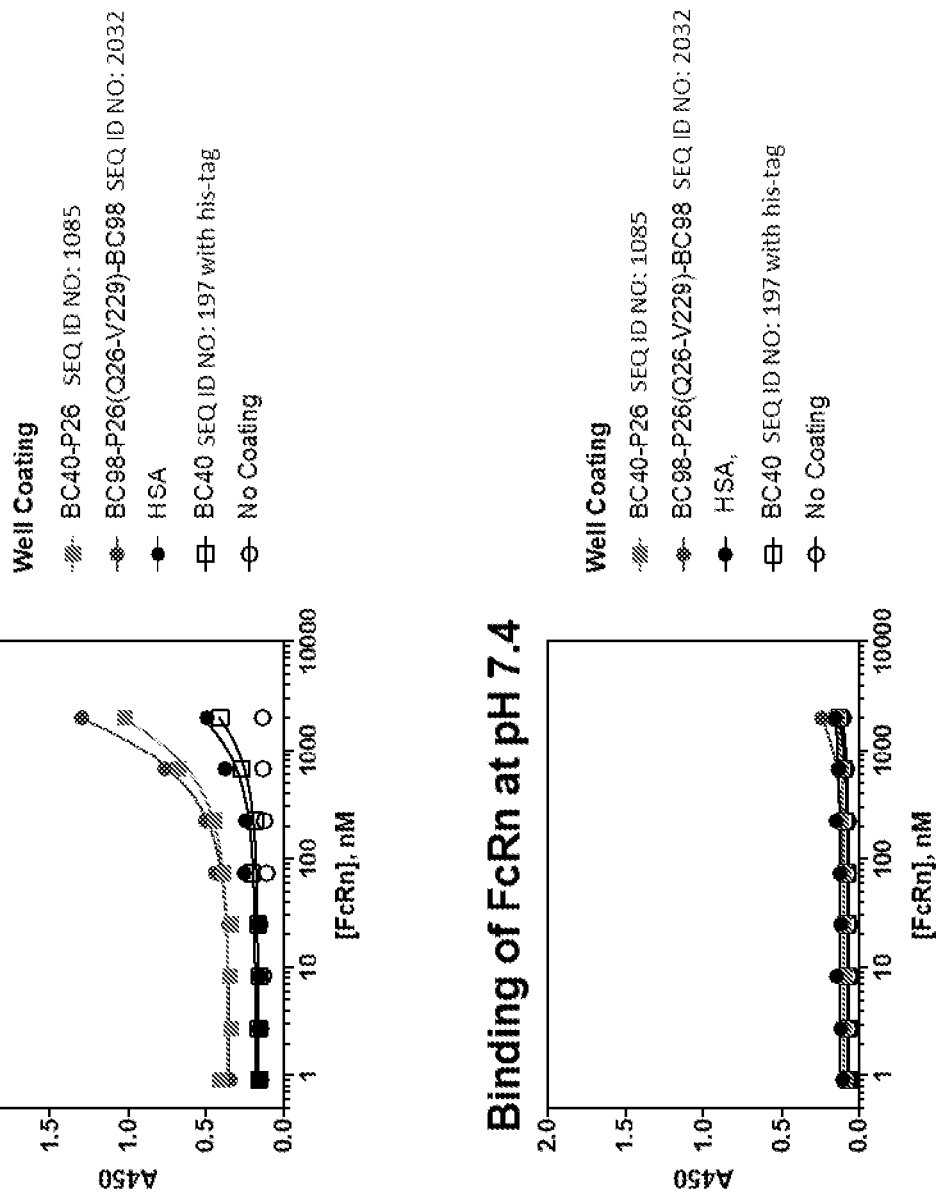

FIG. 10 shows that binding of truncated and full length p26 to human FcRn is pH dependent.

Figure 11A:
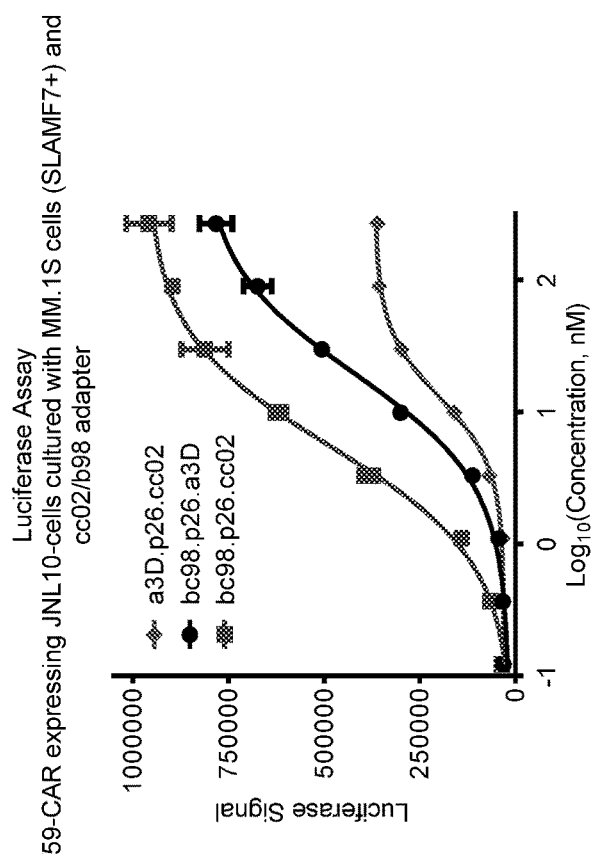
Figure 11B:
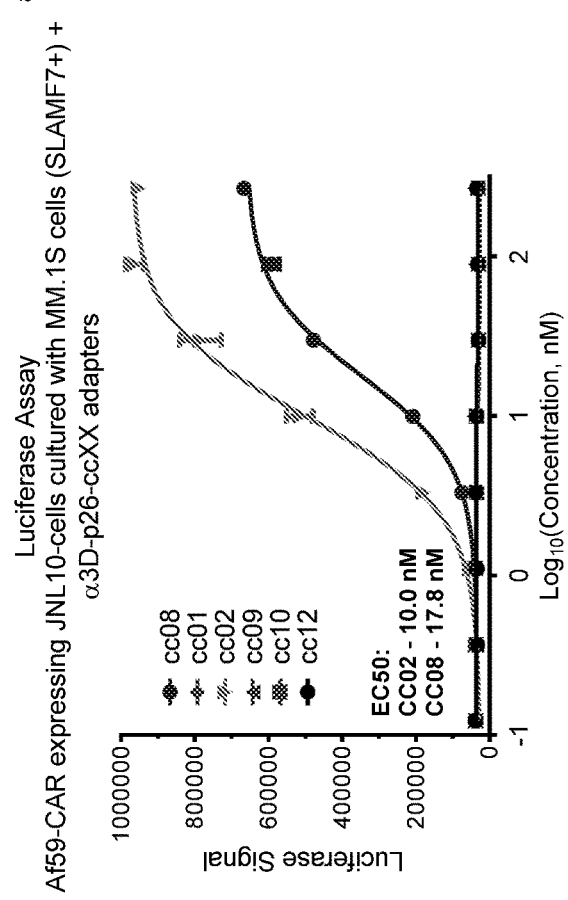
Figure 11C:
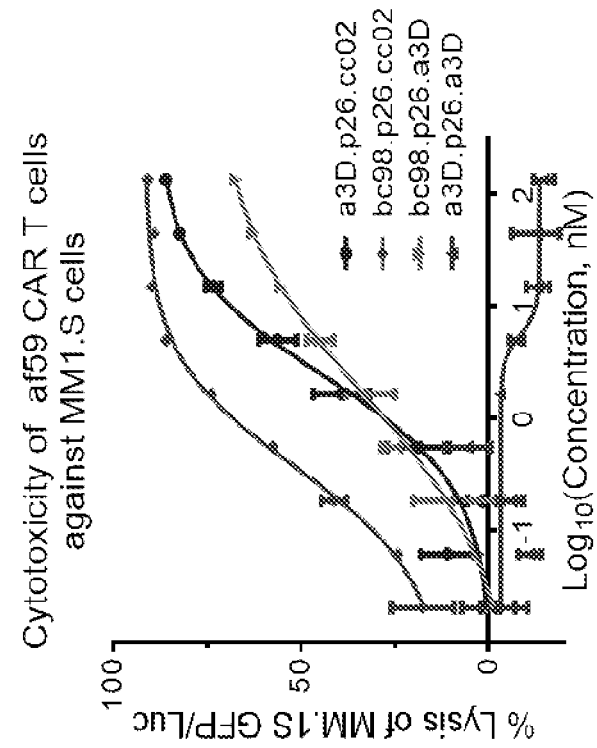
Figure 11D:
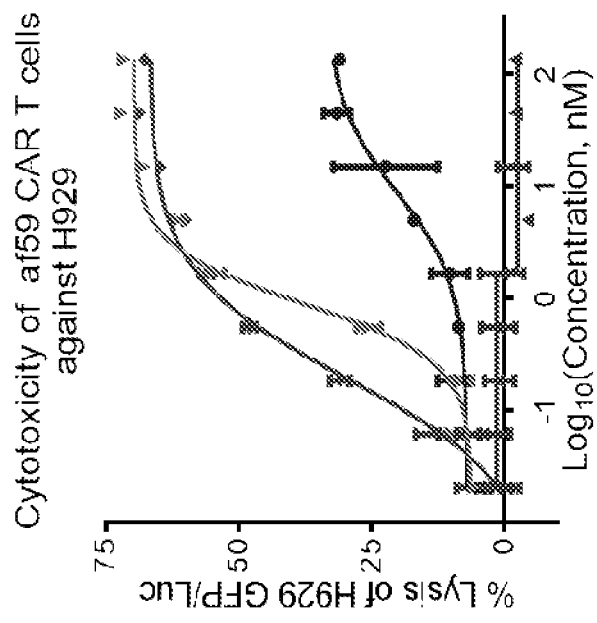

FIGS. 11A-11D show that adapters comprising CS1 (SLAMF7, CRACC, CD319) specific ADBD modulate intracellular signaling and killing of CS1 positive tumors. In FIG. 11A, the cc02 and cc08 ADBD displayed the most potent NFAT signaling when cultured in the presence of af59-CAR expressing JNL10 cells (FIG. 11A) and the CS1 positive tumor cell line, MM.1S. FIG. 11B shows that the bispecific bc98-p26-cc02 adapter capable of binding both CS1 and BCMA was more potent in its ability to signal than were the monospecific BCMA-binding bc98-p26-α3DQ19E adapter and the monospecific CS1-binding α3DQ19E-p26-cc02 adapter. FIGS. 11C and 11D indicate the bispecific bc98-p26-cc02 is an effective adapter in killing HT929 (high expression of both BCMA and CS1; FIG. 11C) and MM.1S (high BCMA, low CS1; FIG. 11D).

Figure 12A:
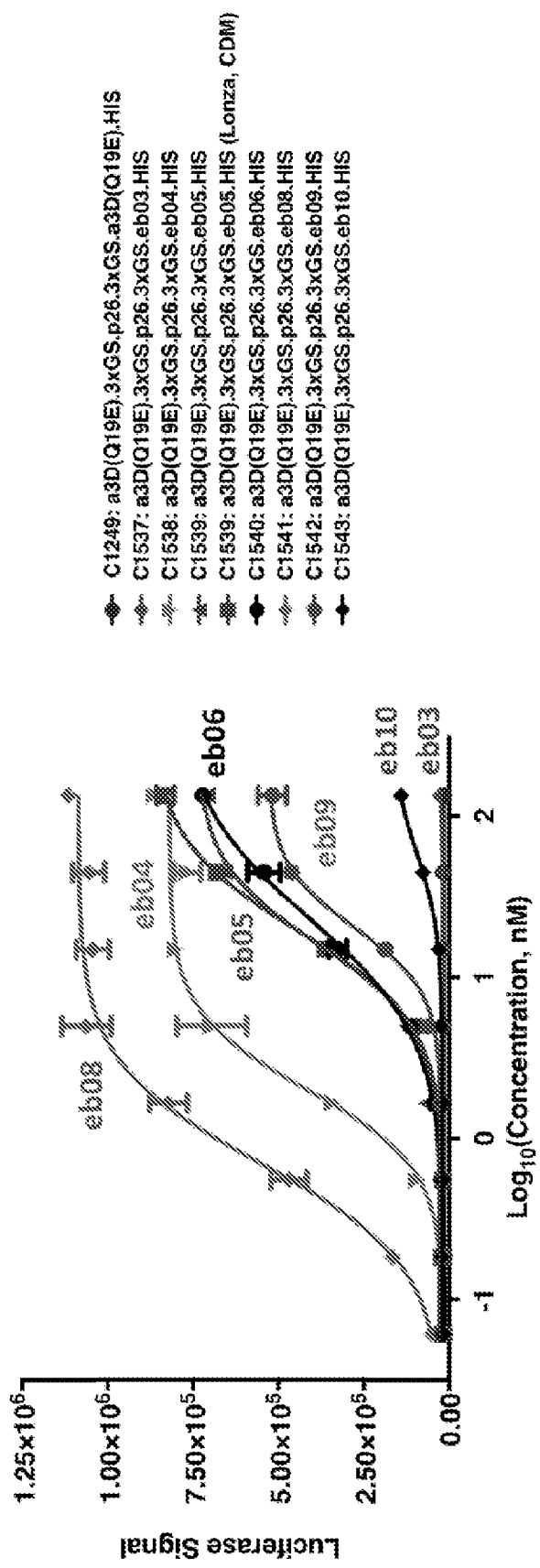
Figure 12C:
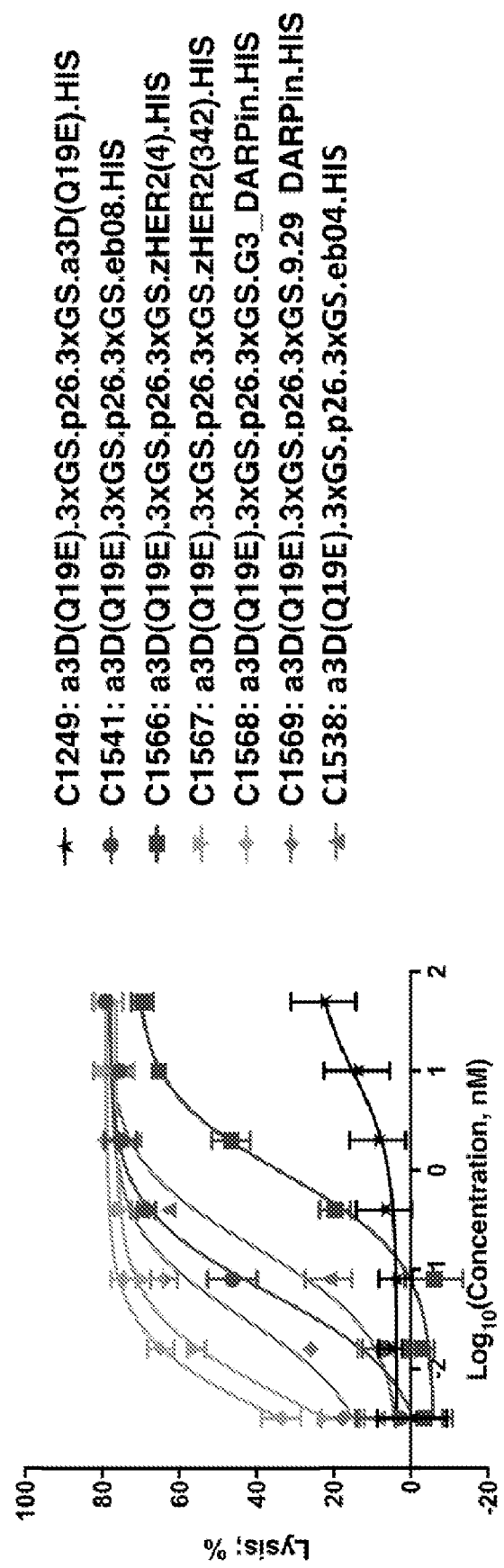

FIGS. 12A-12C show that adapters comprising HER2 binding ADBD induce signaling in Af59-CAR expressing JNL10-cells cultured with HER2-positive SKBR3 tumor. FIG. 12A shows that the adapter comprising eb08 HER2-binding ABDB was the most potent stimulator in this assay. FIG. 12B shows that the NFAT signaling in JNL10 cells mediated by the adapter comprising eb08 is greater than that of mediated by the adapter comprising zHERs:4, comparable to that of mediated by the adapter comprising 9.29, and less than that of G3 and zHER2:342. FIG. 12C demonstrates that adapters comprising the HER2-binding eb08 or eb04 modulate tumor lysis in a dose-dependent manner.

DETAILED DESCRIPTION

I. Definitions

Unless defined otherwise, all technical and scientific terms used herein have the same meaning as commonly understood by one of ordinary skill in the art to which the disclosure pertains.

It is understood that wherever embodiments are described herein with the language "comprising" otherwise analogous embodiments described in terms of "consisting of" and/or "consisting essentially of" are also provided. However, when used in the claims as transitional phrases, each should be interpreted separately and in the appropriate legal and factual context (e.g., "comprising" is considered more of an open-ended phrase while "consisting of" is more exclusive and "consisting essentially of" achieves a middle ground).

As used herein, the singular form "a", "an", and "the" includes plural references unless indicated otherwise.

The term "and/or" as used in a phrase such as "A and/or B" herein is intended to include both A and B; A or B; A (alone); and B (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

"About" as the term is used herein, when referring to a measurable value such as an amount, a temporal duration, and other measurable values known in the art, is meant to encompass variations of ±20% or in some embodiments ±10%, or in some embodiments ±5%, or in some embodiments ±1%, or in some embodiments ±0.1% from the specified value, as such variations are appropriate to perform the disclosed methods.

The terms "protein" and "polypeptide" are used interchangeably herein to refer to a biological polymer comprising units derived from amino acids linked via peptide bonds; a protein can be composed of two or more polypeptide chains.

"Cell surface receptor" refers to molecules and complexes of molecules capable of receiving a signal and the transmission of such a signal across the plasma membrane of a cell. An example of a cell surface receptor provided herein is an activated integrin receptor, for example, an activated αvβ3 integrin receptor on a metastatic cell. As used herein, "cell surface receptor" also includes a molecule expressed on a cell surface that contains a CAR capable of binding an antigenic determinant target of interest. The term "receptor" denotes a cell-associated protein that binds to, or otherwise interacts with, a molecule (e.g., a ligand) and mediates the effect of the ligand on the cell. In several embodiments, the molecule that interacts with a receptor is a bioactive molecule. Membrane-bound cell-surface receptors are characterized by a multi-domain structure comprising an extracellular ligand-binding domain, a membrane spanning domain, and an intracellular effector domain that is typically involved in signal transduction.

The term "Chimeric antigen receptor" or "CAR" or "CARS" as used herein refers to an engineered chimeric polypeptide that grafts an antigen or target specificity onto a cell such as an immune cell (e.g., a T cell such as a naive T cell, central memory T cell, effector memory T cell, NK cell, NKT cell. or a plurality or combination thereof). CARs may also be referred to herein as artificial T cell receptors, chimeric T cell receptors or chimeric immunoreceptors. The CARs share structural or functional properties with a cell immune-function receptor or Adapter molecule. Upon binding to cognate antigen, a CAR can activate or inactivate the cytotoxic cell in which it is disposed, or modulate the cell's antitumor activity or otherwise modulate the cells immune response. In some embodiments, CARs comprise one or more element (e.g., domain) from a T cell receptor (TCR, e.g., the zeta chain associated with the T cell receptor complex) or a natural killer cell receptor (NKR). In some embodiments, CARs comprise (1) an antigenic determinant binding domain (ADBD) that specifically binds to antigenic determinant (AD), (2) a transmembrane domain, and (3) an intracellular domain. In some embodiments, CARs comprise more than one antigenic determinant binding domains. In some embodiments, CARs comprise more than one antigenic determinant binding domains that bind to different antigenic determinants of the same antigen, different antigenic determinants on different antigens, or antigenic determinants expressed by different target cells.

The term "immune cell" as used herein refers to the cells of the mammalian immune system including but not limited to antigen presenting cells, B-cells, basophils, cytotoxic T cells, dendritic cells, eosinophils, granulocytes, helper T cells, leukocytes, lymphocytes, macrophages, mast cells, memory cells, monocytes, natural killer cells, neutrophils, phagocytes, plasma cells and T cells.

The terms "T cell" and "T-lymphocyte" are interchangeable and used synonymously herein. Examples include but are not limited to naive T cells, central memory T cells, effector memory T cells or combinations thereof.

"Autologous" as the term is used herein refers to any material derived from the same individual to whom it is later to be re-introduced.

"Allogeneic" as the term is used herein refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "effector cells" are leukocytes which express one or more FcRs and perform effector functions. Preferably, the cells express at least FcRIII and perform ADCC effector function. Examples of human leukocytes which mediate ADCC include peripheral blood mononuclear cells (PBMC), natural killer (NK) cells, monocytes, cytotoxic T cells and neutrophils; with PBMCs and NK cells being preferred in certain embodiments. The effector cells can be isolated from native source thereof, e.g., from blood or PBMCs as described herein or otherwise known in the art. In a specific embodiment, the effector cells are human effector cells.

The term "effector function" refers to the specialized immune function of a differentiated cell. Effector function of a T cell, for example, may be cytolytic activity or helper activity including the secretion of cytokines.

The term "immune response" as used herein refers to immunities including but not limited to innate immunity, humoral immunity, cellular immunity, immunity, inflammatory response, acquired (adaptive) immunity, autoimmunity and/or overactive immunity. Indicators of an immune response may include secretion of cytokines by immune cells, expansion of immune cell populations, production of antibodies, degranulation of cytotoxic cells, and killing of target cells. Such indicators may routinely be measured using readily available assays, e.g., ELISA or ELISpot, known in the art.

The term "Adapter" as used herein refers to a multi-domain soluble protein that comprises an antigenic determinant (AD) and an antigenic determinant binding domain (ADBD), wherein the ADBD binds to a second AD. In addition to the AD and the ADBD, an Adapter can comprise additional AD, additional ADBD, and/or other additional domains.

The terms "antibody" or "immunoglobulin," as used interchangeably herein, includes whole antibodies. A whole antibody comprises at least two heavy (H) chains and two light (L) chains interconnected by disulfide bonds. Each heavy chain is comprised of a heavy chain variable region (abbreviated herein as VH) and a heavy chain constant region. The heavy chain constant region is comprised of three domains, CH1, CH2, and CH3. Each light chain is comprised of a light chain variable region (abbreviated herein as VL) and a light chain constant region. The light chain constant region is comprised of one domain, C1. The VH and VL regions can be further subdivided into regions of hypervariability, termed Complementarity Determining Regions (CDRs), interspersed with regions that are more conserved, termed framework regions (FW). Each VH and VL is composed of three CDRs and four FWs, arranged from amino-terminus to carboxy-terminus in the following order: FW1, CDR1, FW2, CDR2, FW3, CDR3, FW4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system.

The terms "antibody fragments" and the like as used herein, include any functional domain of an antibody such as an antigen-binding fragment or single chains thereof, an effector domain, salvage receptor binding epitope, or portion thereof. The antibody fragments described herein may exist in a variety of forms. Examples of antibody fragments include, but are not limited to, Fab, Fab', F(ab')2, and Fv fragments, an disulfide-linked Fv (sdFv), a Fd fragment consisting of VH and CH1 domains, an scFv, a minibody, a BiTE, a Tandab, a diabody ((VL-VH)$_2$ or (VH-VL)$_2$), a single domain antibody (e.g., an sdAb such as a nanobody (either VL or VH)), and a camelid VHH domain), and multi-specific antibodies formed from antibody fragments. In some embodiments, an "antibody fragment" corresponds to an antigen-binding site or epitope binding site of an antibody. In other embodiments, an "antibody fragment" corresponds to other functional regions of an antibody such as, an effector domain or portion thereof, or a salvage receptor binding epitope, or portion thereof.

The terms "single chain variable fragment(s)," or "scFv" antibodies as used herein refer to forms of antibodies (e.g., antibody fragments) comprising the variable regions of only the heavy and light chains, connected by a linker peptide. The scFv may comprise VL-linker-VH or may comprise VH-linker-VL. ScFv antibodies are generally 220-250 amino acids in length and contain linkers 10-25 amino acids in length.

As used herein, the term, "Fc region" or simply "Fc" is understood to mean the carboxyl-terminal portion of an immunoglobulin chain constant region, preferably an immunoglobulin heavy chain constant region, or a portion thereof. For example, an immunoglobulin Fc region may comprise (1) a CH1 domain, a CH2 domain, and a CH3 domain, (2) a CH1 domain and a CH2 domain, (3) a CH1 domain and a CH3 domain, (4) a CH2 domain and a CH3 domain, or (5) a combination of two or more domains and an immunoglobulin hinge region. In a preferred embodiment the immunoglobulin Fc region comprises at least an immunoglobulin hinge region a CH2 domain and a CH3 domain, and preferably lacks the CH1 domain. In one embodiment, the class of immunoglobulin from which the heavy chain constant region is derived is IgG (Igγ)(γ subclasses 1, 2, 3, or 4). Other classes of immunoglobulin, IgA (Igα), IgD (Igδ), IgE (Igε) and IgM (Igμ), may be used. The choice of appropriate immunoglobulin heavy chain constant region is discussed in detail in U.S. Pat. Nos. 5,541,087, and 5,726,044, each of which is incorporated by reference herein, in their entirety. The choice of particular immunoglobulin heavy chain constant region sequences from certain immunoglobulin classes and subclasses to achieve a particular result is considered to be within the level of skill in the art. The portion of the DNA construct encoding the immunoglobulin Fc region preferably comprises at least a portion of a hinge domain, and preferably at least a portion of a CH3 domain of Fc gamma or the homologous domains in any of IgA, IgD, IgE, or IgM. Furthermore, it is contemplated that substitution or deletion of amino acids within the immunoglobulin heavy chain constant regions may be useful in the practice of the methods and compositions disclosed herein. One example would be to introduce amino acid substitutions in the upper CH2 region to create an Fc variant with reduced affinity for Fc receptors (Cole, J. Immunol. 159: 3613 (1997)).

"Antibody-dependent cell-mediated cytotoxicity" or "ADCC" refer to a cell-mediated reaction in which nonspecific cytotoxic cells that express Fc receptors (FcRs)(e.g., Natural Killer (NK) cells, neutrophils, and macrophages) recognize bound antibody on a target cell and subsequently cause lysis (or other cytotoxic effects) of the target cell. To assess ADCC activity of a molecule of interest, any in vitro ADCC assay known in the art can be used, such as that described in U.S. Pat. Nos. 5,500,362 or 5,821,337. Useful effector cells for such assays include, but are not limited to, peripheral blood mononuclear cells (PBMC) and Natural Killer (NK) cells. Alternatively, or additionally, ADCC activity of the molecule of interest can be assessed in vivo, e.g., in an animal model such as that disclosed in Clynes et al., PNAS 95: 652-656 (1998).

The term "antigenic determinant binding domain" or "ADBD" as the term is used herein, refers to a sequence of a polypeptide (e.g., an Adapter or CAR) that is sufficient to confer recognition and specific binding to a target antigenic determinant (AD). In some embodiments, the ADBD is an antigen-binding antibody fragment, a scFv, or an antigen-binding peptide that is not based on an antibody or antibody fragment sequence (e.g., a D domain or an affibody). In some embodiments, the ADBD comprises a non antibody-based binding scaffold (e.g., a D domain, affibody, fibronectin domain, nanobody, lipocalin domain ankyrin domain, maxybody, Protein A domain, or affilin domain). In some embodiments the ADBD is a D domain. In some embodiments, the ADBD is an antibody-based binding sequence. In some embodiments the ADBD is a scFv or a domain antibody (dAb). In some embodiments, the ADBD has the ability to bind to a target antigen on the surface of a cell. In some embodiments, the ADBD has the ability to bind to a target antigen on the surface of an immune effector cell. In some embodiments, the ADBD has the ability to bind a growth factor receptor or a hormone receptor.

In particular embodiments, the ADBD is a non antibody-scaffold based polypeptide sequence that is sufficient to confer recognition and specific binding to a target antigenic determinant. In some embodiments, non-antibody based ADBD is a polypeptide that has the ability to bind to target antigen on the surface of a cell. In some embodiments, the non-antibody based ADBD has the ability to bind a growth factor receptor or a hormone receptor. In some embodiments, the ADBD is a D domain-based polypeptide. In particular embodiments, the ADBD is a D domain-based polypeptide that is sufficient to confer recognition and specific binding to a target antigenic determinant. In some embodiments, the ADBD is a D domain-based polypeptide that has the ability to bind to target antigen on the surface of a cell. In some embodiments, the ADBD is a D domain-based polypeptide that has the ability to bind a growth factor receptor or a hormone receptor. In some embodiments, the ADBD is a D domain-based polypeptide that has the ability to bind a target antigen on a serum protein.

The terms "specifically binds" or "having selective affinity for" mean that a binding agent such as an Adapter or CAR, reacts or associates more frequently, more rapidly, with greater duration, with greater affinity, or with some combination of the above to the epitope, protein, or target molecule than with alternative substances, including proteins unrelated to the target epitope. Because of the sequence identity between homologous proteins in different species, specific binding can, in several embodiments, include a binding agent that recognizes a protein or target in more than one species. Likewise, because of homology within certain regions of polypeptide sequences of different proteins, specific binding can include a binding agent that recognizes more than one protein or target. It is understood that, in certain embodiments, a binding agent that specifically binds a first target may or may not specifically bind a second target. As such, "specific binding" does not necessarily require (although it can include) exclusive binding, e.g., binding to a single target. Thus, a binding agent may, in certain embodiments, specifically bind more than one target. In certain embodiments, multiple targets may be bound by the same antigen-binding site on the binding agent.

The terms "linker," "spacer," and "hinge" are used interchangeably herein to refer to a peptide or other chemical linkage located between two or more otherwise independent functional domains of an Adapter or CAR. For example, a linker may be located between an antigenic determinant domain and an antigenic determinant binding domain of an Adapter. Similarly, a linker may be located between two antigenic determinant binding domains or an antigenic binding domain and a transmembrane domain of a CAR. Suitable linkers for coupling the two or more domains of an Adapter are described herein and/or will otherwise be clear to a person skilled in the art.

The term "operably linked," as used herein, indicates that two molecules are attached so as to each retain at least some level of functional activity that each molecule had alone (assuming that each molecule had a function activity). In embodiments when one molecule was without functional activity, it is operably linked with another molecule if the other molecule retains at least some level of its functional activity. Operably linked can also refer to linkage of two non-function molecules. Two molecules can be "operably linked" whether they are attached directly or indirectly (e.g., via a linker).

"Target" refers to any molecule or combination of molecules that can be bound by an Adapter or CAR, or a component of the Adapter or CAR such as antigenic determinant binding domain.

The term "target cell" as used herein refers to cells which are involved in a disease and can be targeted by a CAR, an Adapter, and/or CAR/Adapter composition provided herein. Target cells include any cell in a subject (e.g., a human or animal) that can be targeted by a CAR, an Adapter, and/or CAR/Adapter composition. The target cell can be a cell expressing or overexpressing a target specifically bound by a CAR, Adapter, and/or CAR/Adapter composition.

Expressions like "binding affinity for a target", "binding to a target" and analogous expressions known in the art refer to a property of a polypeptide which may be directly measured through the determination of the affinity constants, e.g., the amount of Adapter that associates and dissociates at a given antigen concentration. Different methods can be used to characterize the molecular interaction, such as, but not limited to, competition analysis, equilibrium analysis and microcalorimetric analysis, and real-time interaction analysis based on surface plasmon resonance interaction (for example using a Biacore® instrument). These methods are well-known to the skilled person and are described, for example, in Neri et al., Tibtech 14: 465-470 (1996), and Jansson et al., J. Biol. Chem. 272: 8189-8197 (1997).

"The terms "antigenic determinant" and "epitope" are used interchangeably herein and refer to that portion of any molecule (e.g., a target of interest, or an Adapter) capable of being recognized and specifically bound by a particular binding agent (e.g., an Adapter or CAR). When the recognized molecule is a polypeptide, epitopes can be formed from contiguous amino acids and noncontiguous amino acids and/or other chemically active surface groups of molecules (such as carbohydrates) juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3 amino acids, and more usually, at least 5 or 8-10 amino acids in a unique spatial conformation.

"Derived from" as that term is used herein, indicates a relationship between a first and a second molecule. It generally refers to structural similarity between the first molecule and a second molecule and does not connote or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connote or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The term "naturally occurring" when used in connection with biological materials such as a nucleic acid molecules, polypeptides, antigenic determinants, and host cells, refers to those which are found in nature and not modified by a human being. Conversely, "non-natural" or "synthetic" when used in connection with biological materials refers to those which are not found in nature and have been modified by a human being.

As used herein "modifications" with respect to a sequence of reference includes substitutions, deletions insertions and/or additions of a sequence when compared to the corresponding amino acid position(s) of the reference sequence.

A "substitution" with respect to a sequence of reference refers to a replacement of a particular amino acid residue with a different amino acid residue at a corresponding amino acid position of the reference sequence.

A "conservative" amino acid substitution is one in which one amino acid residue is replaced with another amino acid residue having a similar side chain Families of amino acid residues having similar side chains have been defined in the art, including basic side chains (e.g., lysine (K), arginine (R), histidine (H)), acidic side chains (e.g., aspartic acid (D), glutamic acid (E)), uncharged polar side chains (e.g., glycine (G), asparagine (N), glutamine (Q), serine (S), threonine (T), tyrosine (Y), cysteine (C)), nonpolar side chains (e.g., alanine (A), valine (V), leucine (L), isoleucine (I), proline (P), phenylalanine (F), methionine (M), tryptophan (W), beta-branched side chains (e.g., threonine (T), valine (V), isoleucine (I)) and aromatic side chains (e.g., tyrosine (Y), phenylalanine (F), tryptophan (W), histidine (H)). For example, substitution of a phenylalanine for a tyrosine is a conservative substitution. In one embodiment, conservative substitutions in the sequences of the Adapter or CAR results in a retained specific binding of the Adapter or CAR containing the substitution to the target of interest to which it binds. Methods of identifying nucleotide and amino acid conservative substitutions and non-conservative substitutions which confer, alter or maintain selective binding affinity are known in the art (see, e.g., Brummell, Biochem. 32: 1180-1187 (1993); Kobayashi, Protein Eng. 12(10): 879-884 (1999); and Burks, PNAS 94: 412-417 (1997)).

A "non-conservative" amino acid substitution is one in which one amino acid residue is replaced with another amino acid residue having a dissimilar side chain. In one embodiment, non-conservative substitutions in the sequences of the Adapter or CAR result in a retained specific binding of the Adapter or CAR containing the substitution to the target of interest to which it binds.

"Non natural amino acids," "amino acid analogs" and "non-standard amino acid residues" are used interchangeably herein. Non-natural amino acids that can be substituted in an Adapter as provided herein are known in the art. In one embodiment the non-natural amino acid is 4-hydroxyproline which can be substituted for proline; 5-hydroxylysine which can be substituted for lysine; 3-methylhistidine which can be substituted for histidine; homoserine which can be substituted for serine; and ornithine which can be substituted for lysine. Additional examples of non-natural amino acids that can be substituted in an Adapter include, but are not limited to molecules such as: D-isomers of the common amino acids, 2,4-diaminobutyric acid, alpha-amino isobutyric acid, A-aminobutyric acid, Abu, 2-amino butyric acid, gamma-Abu, epsilon-Ahx, 6-amino hexanoic acid, Aib, 2-amino isobutyric acid, 3-amino propionic acid, ornithine, norleucine, norvaline, hydroxyproline, sarcosine, citrulline, homocitrulline, cystic acid, t-butylglycine, t-butylalanine, phenylglycine, cyclohexylalanine, beta-alanine, lanthionine, dehydroalanine, γ-aminobutyric acid, selenocysteine and pyrolysine fluoro-amino acids, designer amino acids such as beta-methyl amino acids, C alpha-methyl amino acids, and N alpha-methyl amino acids, or combinations of non-natural amino acids. Still additional non-natural amino acids can include 4-amino butyric acid, 4-amino-3-hydroxy-5-phenyl-pentanoic acid, 4-amino-3-hydroxy-6-methylheptanoic acid, 2-thienyl alanine, and/or D-isomers of amino acids. As discussed herein, in several embodiments non-natural amino acids or amino acid analogs can include deletion of one or more amino acids from a sequence.

The terms "polynucleotide" and "nucleic acid," used interchangeably herein, refer to a polymeric form of nucleotides of any length, either ribonucleotides or deoxyribonucleotides. These terms include, but are not limited to, DNA, RNA, cDNA (complementary DNA), mRNA (messenger RNA), rRNA (ribosomal RNA), shRNA (small hairpin RNA), snRNA (small nuclear RNA), snoRNA (short nucleolar RNA), miRNA (microRNA), genomic DNA, synthetic DNA, synthetic RNA, and/or tRNA. In some embodiments, an isolated polynucleotide is a modified mRNA comprising non-naturally occurring nucleosides or nucleotides. In some embodiments, a modified mRNA comprises 2-thiouridine, pseudouridine, or 1-methylpseudouridine.

The term "naked DNA" as used herein refers to DNA (e.g., histone free DNA) encoding a protein, such as an Adapter or a CAR, that is cloned in a suitable expression vector in proper orientation for expression (e.g., a plasmid). Viral vectors which may be used include but are not limited to SIN lentiviral vectors, retroviral vectors, foamy virus vectors, adenovirus vectors, adeno-associated virus (AAV) vectors, hybrid vectors and/or plasmid transposons (for example sleeping beauty transposon system) or integrase based vector systems. Other vectors that can be used in connection with making and using Adapters and CARs are described herein or otherwise known in the art.

The terms "vector", "cloning vector" and "expression vector" as used herein refer to the vehicle by which a nucleic acid sequence (e.g., an Adapter or CAR coding sequence) can be maintained or amplified in a host cell (e.g., cloning vector) or introduced into a host cell, so as to transform the host and promote expression (e.g., transcription and translation) of the introduced sequence. Vectors include plasmids, phages, viruses, etc.

A "host cell" includes an individual cell or cell culture which can be or has been a recipient of nucleic acids encoding an Adapter or CAR. Host cells include but are not limited to viral particles, phagemids, bacteria, yeast, plant, animal, and mammalian cells. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo, in vitro, or ex vivo with nucleic acids encoding an Adapter or CAR. In some examples, the host cell is capable of expressing an Adapter. In some examples, the host cell is capable of expressing and secreting an Adapter. In some examples, the host cell is capable of expressing a CAR. In some examples, the host cell is capable of expressing and displaying a CAR on its surface. "Expression" includes transcription and/or translation.

As used herein, the terms "pharmaceutically acceptable," or "physiologically tolerable" and grammatical variations thereof, as they refer to compositions, carriers, diluents and reagents, are used interchangeably and represent that the materials are capable of administration to or upon a human without the production of therapeutically prohibitive undesirable physiological effects such as nausea, dizziness, gastric upset and other therapeutically prohibitive undesirable physiological effects known in the art.

"Parenteral" administration of an immunogenic composition includes, e.g., subcutaneous (s.c.), intravenous (i.v.), intramuscular (i.m.), or intrasternal injection, or infusion techniques.

The term "stimulate" or "stimulation" refers to a primary response induced by binding of a stimulatory molecule with its cognate ligand thereby mediating a signal transduction event, such as, but not limited to, signal transduction via the appropriate receptor, e.g., T or NK receptor.

"Modulate" or "modulation" means adjustment or regulation of amplitude, frequency, degree, or activity. In another related aspect, such modulation may be positively modulated (e.g., an increase in frequency, degree, or activity) or negatively modulated (e.g., a decrease in frequency, degree, or activity). In several embodiments, modulation in a positive or negative direction is referenced as compared to the cell, tissue, or organ function prior to administration of a therapeutic. In additional embodiments, modulation in a positive or negative direction is referenced with respect to a normal, healthy cell, tissue or organ.

An "effective amount" of a CAR cell, Adapter, and/or CAR cell/Adapter composition as provided herein is an amount sufficient to carry out a specifically stated purpose such as to bring about an observable change in the level of one or more biological activities related to the target to which the CAR cell and/or Adapter binds. In certain embodiments, the change increases the level of target activity. In other embodiments, the change decreases the level of target activity. An "effective amount" can be determined empirically and in a routine manner, in relation to the stated purpose. The term "therapeutically effective amount" refers to an amount of a CAR cell and/or Adapter, or other therapeutic agent effective to "treat" (e.g., reduce symptoms of) a disease or disorder in a subject (mammal). A "prophylactically effective amount" refers to an amount effective, at dosages and for periods of time necessary, to achieve the desired prophylactic result.

"Patient," "subject," "animal" and "mammal" are used interchangeably and refer to mammals such as human patients and non-human primates, as well as experimental animals such as rabbits, rats, and mice, and other animals. Animals include all vertebrates, e.g., mammals and non-mammals, such as chickens, amphibians, and reptiles. "Mammal" as used herein refers to any member of the class Mammalia, including, without limitation, humans and non-human primates such as chimpanzees and other apes and monkey species; farm animals such as cattle, sheep, pigs, goats and horses; domestic mammals such as dogs and cats; laboratory animals including rodents such as mice, rats and guinea pigs, and other members of the class Mammalia known in the art. In a particular embodiment, the patient is a human. The term does not denote a particular age or sex. Thus, adult and newborn subjects, as well as embryos and fetuses, whether male or female, are intended to be included within the scope of this term.

The terms "treat," "treatment," and "treating," as used herein refer to both therapeutic treatment and prophylactic or preventative measures, wherein the object is to prevent or slow down (lessen or delay) the symptoms, complications, or biochemical indicia of a disease, condition, or disorder, alleviating the symptoms or arresting or inhibiting further development of the disease, condition, or disorder. Treatment can be prophylactic (to prevent or delay the onset of the disease, or to prevent the manifestation of clinical or subclinical symptoms thereof) or therapeutic suppression or alleviation of symptoms after the manifestation of the disease, condition, or disorder targeted pathologic condition, prevent the pathologic condition, pursue or obtain beneficial results, or lower the chances of the individual developing the condition even if the treatment is ultimately unsuccessful. Those in need of treatment include those already with the condition as well as those prone to have the condition or those in whom the condition is to be prevented. Treatment can be with a CAR cell, Adapter, and/or CAR cell/Adapter composition, alone or in combination with an additional therapeutic agent. In some embodiments, the terms "treat," "treatment," and "treating," are used herein to refer to therapeutic treatment and prophylactic or preventative measures, wherein the object is to prevent or slow down (lessen or delay) the symptoms, complications, or biochemical indicia of a proliferative disorder, or the amelioration of one or more symptoms (preferably, one or more discernible symptoms) of a proliferative disorder. In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating" refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size, tumor cell proliferation or survival, or cancerous cell count.

"Cancer," "tumor," or "malignancy" are used as synonymous terms and refer to any of a number of diseases that are characterized by uncontrolled, abnormal proliferation of cells, the ability of affected cells to spread locally or through the bloodstream and lymphatic system to other parts of the body (metastasize) as well as any of a number of characteristic structural and/or molecular features. "Tumor," as used herein refers to all neoplastic cell growth and proliferation, whether malignant or benign, and all pre-cancerous and cancerous cells and tissues. A "cancerous tumor," or "malignant cell" is understood as a cell having specific structural properties, lacking differentiation and being capable of invasion and metastasis. Cancers that can be treated using a CAR cell, Adapter, and/or CAR cell/Adapter composition provided herein include without limitation, breast, lung, brain, cervical, skin, bone, liver, pancreatic, colorectal, renal, head and neck, ovarian, hematopoietic (e.g., leukemia), and prostate cancer, and lymphoma. Other types of cancer and tumors that may be treated using a CAR cell, Adapter, and/or CAR cell/Adapter composition are described herein or otherwise known in the art. A reference to cancers, tumors, or tumor cells of a particular "type" is understood to mean cancer, tumors, or tumor cells characterized by a specific disease. For example, in some embodiments a first and second cancer of the same type is mixed cellularity Hodgkin's lymphoma and lymphocyte rich Hodgkin's lymphoma. In other embodiments a first and second cancer of the same type is precursor B cell acute lymphoblastic leukemia (ALL) and mature B cell ALL. Examples of a first and second cancer of a different type include, for example, Hodgkin's lymphoma and ALL.

The term "tumor antigen" refers to an antigen that is common to a specific hyperproliferative disorder such as cancer. The terms "tumor antigen" or "cancer antigen" are used interchangeably herein. In certain aspects, antigens are derived from cancers including but not limited to primary or metastatic melanoma, thymoma, lymphoma, sarcoma, lung cancer (e.g., NSCLC or SCLC), liver cancer, non-Hodgkin's lymphoma, Hodgkin's lymphoma, leukemias, multiple myeloma, glioblastoma, neuroblastoma, uterine cancer, cervical cancer, renal cancer, thyroid cancer, bladder cancer, kidney cancer, mesothelioma, and adenocarcinomas such as breast cancer, prostate cancer, ovarian cancer, pancreatic cancer, colon cancer and other cancers known in the art. In some embodiments, the cancer is B-cell acute lymphoid leukemia ("BALL"), T cell acute lymphoid leukemia ("TALL"), acute lymphoid leukemia (ALL), acute myelogenous leukemia (AML); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia.

Tumor and cancer antigens may be further defined as "tumor-specific antigens (TSA)", "cancer-specific antigens (CSA)", "tumor-associated antigens (TAA)", or "cancer-associated antigens (CAA)". A TSA is an antigen that is unique to tumor cells and does not occur on other cells in the body. A TAA is an antigen that is found on both tumor and some normal cells. A TAA may be expressed on normal cells under conditions that fail to induce a state of immunologic tolerance to the antigen. The expression of the TAAs on the tumor may occur under conditions that enable the immune system to respond to the antigen. TAAs may be expressed on normal cells during fetal development when the immune system is immature and unable to respond or may be normally present at extremely low levels on normal cells but which are expressed at much higher levels on tumor cells. Because of the dynamic nature of tumors, in some instances, tumor cells may express unique antigens at certain stages, and at others also express antigens that are also expressed on non-tumor cells. Thus, inclusion of a certain marker as a TAA does not preclude it being considered a TSA. In some embodiments, the TAA and/or TSA that contains an antigenic determinant specifically bound by a CAR cell, Adapter, and/or CAR cell/Adapter composition provided herein, is selected from: BCMA, CD19, CD20, CD22, CD30, CD33/1L3Ra, CD70, CD123, CD171 (L1-CAM), CS1, EGFRvIII, GD2, Lewis$^Y$, ROR 1, mesothelin, IL13Ra2, cMet, PSMA, folate receptor alpha (FR-alpha), CEA, ErbB2 (HER-2/neu); EGFR (HER), PSCA, PSA, MUC1, MUC16, CD44v6, CD44v6/7, CD44v7/8, CD55, IL11Ra, EphA2, EGP40, TAG72, CAIX, HMW-MAA (CSPG4), MAGEA4, NKG2D ligands, beta-HCG, Glycolipid F77, HLA-A2 (NY-ESO-1), HMW-MAA, GD3, TCR, MAGE A3, MART1, WT1, thyroglobulin, gp100 (Pmel 17), tyrosinase, TRP1, TRP2, HLA-A1, MAGE1, MAGE3, BAGE, GAGE1, GAGE2, pi5, p53, Ras, BCR-ABL, E2A-PRL, H4-RET, IGH-IGK, MYL-RAR; VEGFR2, FAP, FAR, EBVA, HPV antigen E6, HPV antigen E7, TSP-180, MAGE4, MAGE5, MAGE6, RAGE, p185erbB2, p180erbB3, nm-23H1, CA 19-9, CA72-4, CAM 17.1, NuMa, K-ras, beta-Catenin, CDK4, Mum-1, p15, p16, 43-9F, alpha-fetoprotein, BCA225, BTAA, CA125, CA 15-3, CA 27.29(BCAA), CA195, CA242, CA50, CAM43, CD68, CO-029, FGF5, G250, HTgp-175, M344, MA50, MG7-Ag, NB/70K, NY-CO-1, RCAS1, SDCCAG16, M2BP, TAAL6, TLP, and TPS.

The term "CS1" as used herein refers to an NK cell receptor regulating immune functions that is also expressed on B cells, T cells, dendritic cells, NK-T cells, and monocytes. CS1 is overexpressed in multiple myeloma and has been successfully targeted for immunotherapy multiple myeloma. Malaer & Mathew, Am J Cancer Res. 7(8): 1637-1641 (2017). CS1 is also known as SLAM7, protein 19A, CRACC, and CD319. The term "CS1" includes variants, isoforms, homologues, orthologs and paralogs. CS1 is a transmembrane protein with various differentially spliced isoforms. In some embodiments, the amino acid sequence of human CS1, comprising a 22 amino acid residue N-terminal signal sequence (MAGSPTCLTLIYILWQLTGSAA, SEQ ID NO: 1119) and an extracellular domain comprising the 226 N-terminal residues (SEQ ID NO: 1120), has Genbank Accession No. NP_067004 (SEQ ID NO: 1121). In some embodiments, the amino acid sequence of human CS1 has Genbank Accession No. NP_001269517, NP_001269518, NP_001269519, NP_001269520, NP_001269521, NP_001269522, NP_001269523, NP_001269524, or NP_001269525.

The term "autoimmune disease" as used herein is defined as a disorder that results from an autoimmune response. An autoimmune disease is the result of an inappropriate and excessive response to a self-antigen. Examples of autoimmune diseases include but are not limited to, Addison's disease, alopecia areata, ankylosing spondylitis, autoimmune hepatitis, autoimmune parotitis, Crohn's disease, diabetes (Type I), dystrophic epidermolysis bullosa, epididymitis, glomerulonephritis, Graves' disease, Guillain-Barr syndrome, Hashimoto's disease, hemolytic anemia, systemic lupus erythematosus, multiple sclerosis, myasthenia gravis, pemphigus vulgaris, psoriasis, rheumatic fever, rheumatoid arthritis, sarcoidosis, scleroderma, Sjogren's syndrome, spondyloarthropathies, thyroiditis, vasculitis, vitiligo, myxedema, pernicious anemia, ulcerative colitis, among others.

The term "transduction" as used herein refers to the introduction of a foreign nucleic acid into a cell using a viral vector. "Transfection" as used herein refers to the introduction of a foreign nucleic acid into a cell using recombinant DNA technology. The term "transformation" means the introduction of a "foreign" (e.g., extrinsic, extracellular, or otherwise non-endogenous) nucleic acid (DNA or RNA) sequence to a host cell, so that the host cell will express the introduced nucleic acid to produce a desired substance, such as a protein or enzyme coded by the introduced coding sequence. The introduced nucleic acid sequence can also be called a "cloned" or "foreign" gene or sequence, can include regulatory or control sequences, such as start, stop, promoter, signal, secretion, or other sequences used by a cell's genetic machinery. The nucleic acid sequence can include nonfunctional sequences or sequences with no known function. A host cell that receives and expresses introduced nucleic acid (e.g., DNA or RNA) has been "transformed" and is a "transformant" or a "clone." The DNA or RNA introduced to a host cell can come from any source, including cells of the same genus or species as the host cell, or cells of a different genus or species or may be non-naturally occurring.

The term "D domain" refers to a target binding polypeptide sharing certain sequence and certain structural features of the reference scaffold sequence: MGSWAEFKQRLAAIK TRLQALGGSEAELAAFEKEIAAF-ESELQAYKGKGNPEVEALRK EAAAIRDELQAYRHN (SEQ ID NO: 1) (see WO 2016/164305 and WO 2016/164308, each of which is incorporated by reference herein in its entirety). The reference scaffold is a variant of a non-naturally occurring and targetless antiparallel three helical bundle reference polypeptide originally engineered as an exercise in protein folding (see, Walsh et al., PNAS 96: 5486-5491 (1999) incorporated by reference herein in its entirety). It has been discovered that polypeptides containing modifications of the targetless reference scaffold having the amino acid sequence of SEQ ID NO: 1 are able to specifically bind targets of interest. Thus, a D domain, or a molecule comprising a D domain, can specifically (non-randomly) bind to a target molecule. While not wishing to be bound by theory, it is believed that in designing the D domain, the structural constraints of surface-exposed residues (that can be modified) confer the ability of the surface exposed residues to specifically bind a target of interest.

"Co-express" as used herein refers to expression of two or more protein coding sequences by the same cell or cell population. The coding sequences may be for example, nucleic acids that each encode a single protein or a chimeric protein as a single polypeptide chain.

"Antigen loss escape variants" as used herein refer to cells which exhibit reduced or loss of expression of the target antigen, which antigenic determinants are targeted by an Adapter or CAR provided herein.

II. Antigenic Determinants (ADs)

Antigenic determinants (ADs) are epitopes that are capable of being recognized and specifically bound by an antigenic determinant binding regions (ADBDs) (e.g., antigen-binding fragments of an antibody or alternative scaffold binding domains (ASBDs) (e.g., D domains)). The ADs in the Adapters and on the target cells provided herein can be bound by the CARs discussed below.

In some embodiments, the AD (e.g., in an Adapter and/or on a target cell) is an AD that is present in a naturally occurring protein or other molecule. In some embodiments, the AD is an AD that is endogenous to humans.

In some embodiments, the AD in the Adapter is an AD that is present on a target cell.

In some embodiments, the AD (e.g., in an Adapter and/or on a target cell) is an AD that is present in a transmembrane protein, e.g., an AD that is present in the extracellular portion of a transmembrane protein. In some embodiments, the AD is a tumor antigen. In some embodiments, the AD is a tumor-associated antigen. In some embodiments, the AD is a tumor-specific antigen.

In some embodiments, the AD (e.g., in an Adapter and/or on a target cell) is a cancer antigen. In some embodiments, the AD is a cancer-associated antigen. In some embodiments, the AD is a cancer-specific antigen.

In some embodiments, the AD (e.g., in an Adapter and/or on a target cell) is an epitope of BCMA. In further embodiments, the AD comprises 5-25, 5-50, 5-75, 5-100, 5-125, or 5-150 amino acid residues, more than 150 amino acid residues, or all of the amino acid residues of SEQ ID NO: 5.

In some embodiments, the AD is an epitope of CD19. In further embodiments, the AD comprises 5-25, 5-50, 5-75, 5-100, 5-125, or 5-150 amino acid residues, more than 150 amino acid residues, or all of the amino acid residues of SEQ ID NO: 3.

In some embodiments, the AD is an epitope of CD20. In further embodiments, the AD comprises 5-25, 5-50, 5-75, 5-100, 5-125, or 5-150 amino acid residues, more than 150 amino acid residues, or all of the amino acid residues of SEQ ID NO: 6-9, or 10.

In some embodiments, the AD is an epitope of CD22. In further embodiments, the AD comprises 5-25, 5-50, 5-75, 5-100, 5-125, or 5-150 amino acid residues, more than 150 amino acid residues, or all of the amino acid residues of SEQ ID NO: 41.

In some embodiments, the AD is an epitope of CD123. In further embodiments, the AD comprises 5-25, 5-50, 5-75, 5-100, 5-125, or 5-150 amino acid residues, more than 150 amino acid residues, or all of the amino acid residues of SEQ ID NO: 11.

In some embodiments, the AD is an epitope of CD37. In further embodiments, the AD comprises 5-25, 5-50, 5-75, 5-100, 5-125, or 5-150 amino acid residues, more than 150 amino acid residues, or all of the amino acid residues of SEQ ID NO: 12 or 13.

In some embodiments, the AD is an epitope of CS1. In further embodiments, the AD comprises 5-25, 5-50, 5-75, 5-100, 5-125, or 5-150 amino acid residues, more than 150 amino acid residues, or all of the amino acid residues of SEQ ID NO: 1139. In further embodiments, the AD is an epitope of CS1 that is bound by elotuzumab.

In some embodiments, the AD is an epitope of HER2. In further embodiments, the AD comprises 5-25, 5-50, 5-75, 5-100, 5-125, or 5-150 amino acid residues, more than 150 amino acid residues, or all of the amino acid residues of SEQ ID NO: 42.

In some embodiments, the AD is an epitope of AFP. In further embodiments, the AD comprises 5-25, 5-50, 5-75, 5-100, 5-125, or 5-150 amino acid residues, more than 150 amino acid residues, or all of the amino acid residues of SEQ ID NO: 15.

In some embodiments, the AD is an epitope of AFP p26. In further embodiments, the AD comprises 5-25, 5-50, 5-75, 5-100, 5-125, or 5-150 amino acid residues, more than 150 amino acid residues, or all of the amino acid residues of SEQ ID NO: 16. In further embodiments, the AD comprises 5-25, 5-50, 5-75, 5-100, 5-125, or 5-150 amino acid residues, more than 150 amino acid residues, or all of the amino acid residues of SEQ ID NO: 1117. In further embodiments, the AD comprises the amino acid residues of SEQ ID NO: 16, 1117, 1118, 1119, 1120, 1121, 1122, or 1123.

In some embodiments, the AD (e.g., in an Adapter and/or on a target cell) is expressed on the surface of an immune effector cell.

In some embodiments, the AD is an epitope of the extracellular domain (ECD) of human CD45. In further embodiments, the AD comprises 5-25, 5-50, 5-75, 5-100, 5-125, or 5-150 amino acid residues, more than 150 amino acid residues, or all of the amino acid residues of residues 29-766 of SEQ ID NO: 1106.

In some embodiments, the AD is an epitope of human CD45 that is bound by the UCHL-1, A6, or ODP4 antibody. In some embodiments, the AD is an epitope of human CD45 that is bound by the 4KB5, MB1, KiB3, 2H4, or MT2 antibody.

In some embodiments, the AD is an epitope of CD26. In further embodiments, the AD comprises 5-25, 5-50, 5-75, 5-100, 5-125, or 5-150 amino acid residues, more than 150 amino acid residues, or all of the amino acid residues of residues 29-766 of SEQ ID NO: 1113.

In some embodiments, the AD is an epitope of CD30. In further embodiments, the AD comprises 5-25, 5-50, 5-75, 5-100, 5-125, or 5-150 amino acid residues, more than 150 amino acid residues, or all of the amino acid residues of residues 19-379 of SEQ ID NO: 1114.

In some embodiments, the AD is an epitope of CD33. In further embodiments, the AD comprises 5-25, 5-50, 5-75, 5-100, 5-125, or 5-150 amino acid residues, more than 150 amino acid residues, or all of the amino acid residues of residues 18-259 of SEQ ID NO: 1115.

In some embodiments, the AD is an epitope of CD38. In further embodiments, the AD comprises 5-25, 5-50, 5-75, 5-100, 5-125, or 5-150 amino acid residues, more than 150 amino acid residues, or all of the amino acid residues of residues 43-300 of SEQ ID NO: 1116.

In some embodiments, the AD is an epitope of a human intracellular protein. In further embodiments, the AD is an epitope of an intracellular portion of a membrane associated receptor protein selected from the group: cytokine receptor, chemokine receptor, T cell receptor, B cell receptor, NK cell receptor, myeloid cell receptor, endothelial cell receptor, and epithelial cell receptor. In some embodiments, the AD is an epitope of the intracellular portion of CD3, CD137, CD279, CD223, CD152, CD28, and VEGFR-2. In some embodiments, the AD is an epitope of a human nuclear protein.

In some embodiments, the AD (e.g., in an Adapter and/or on a target cell) is an epitope of a tumor antigen associated with a malignant tumor. In some embodiments, the AD is an epitope of a tissue-specific antigen from a melanoma. In some embodiments, the AD is an epitope of a tissue-specific melanoma antigen selected from: MART-1, tyrosinase, and GP 100. In some embodiments, the AD is an epitope of a tissue-specific antigen from a prostate cancer. In some embodiments, the tissue-specific prostate cancer antigen is selected from: prostatic acid phosphatase (PAP) and prostate-specific antigen (PSA). In some embodiments, the AD is an epitope of a transformation-related molecule. In further embodiments, the AD is an epitope of ErbB2 (HER2). In some embodiments, the AD is an epitope of an onco-fetal antigen. In some embodiments, the AD is an epitope of carcinoembryonic antigen (CEA). In some embodiments, the AD is an epitope of a B-cell lymphoma-specific idiotype immunoglobulin. In some embodiments, the AD is an epitope of a B-cell differentiation antigen. In some embodiments, the AD is an epitope of a B-cell differentiation antigen selected from: CD19, CD20, and CD37. In some embodiments, the AD is an epitope of an antigen on myeloid cells. In some embodiments, the AD is an epitope of a myeloid cell antigen selected from: TSLPR and IL-7R. In some embodiments, the AD is an epitope of a cancer testis (CT) antigen. In some embodiments, the AD is an epitope of a cancer testis (CT) selected from: NY-ESO-1 and LAGE-1a. In some embodiments, the AD is an epitope of an antigen selected from: CS1, CD38, CD138, MUC1, HM1.24, CYP1B1, SP17, PRAME, Wilms' tumor 1 (WT1), and heat shock protein gp96 on multiple myeloma cells.

In some embodiments, the AD (e.g., in an Adapter and/or on a target cell) is an epitope of a TSA or TAA. In some embodiments, the AD is an epitope of a tumor differentiation antigen. In some embodiments, the AD is an epitope of a tumor differentiation antigen selected from: MART1/MelanA, gp100 (Pmel 17), tyrosinase, TRP1, and TRP2. In some embodiments, the AD is an epitope of a tumor-specific multilineage antigen. In some embodiments, the AD is an epitope of a tumor-specific multilineage antigen selected from: MAGE1, MAGE3, BAGE, GAGE1, GAGE2, and p15. In some embodiments, the AD is an epitope of an overexpressed embryonic antigen. In some embodiments, the AD is an epitope of CEA. In some embodiments, the AD is an epitope of an overexpressed oncogene or mutated tumor-suppressor gene product. In some embodiments, the AD is an epitope of an overexpressed oncogene or mutated tumor-suppressor gene product selected from: p53, Ras, and HER2/neu. In some embodiments, the AD is an epitope of a unique tumor antigen resulting from chromosomal translocations. In some embodiments, the AD is an epitope of a unique tumor antigen resulting from a chromosomal translocation selected from: BCR-ABL, E2A-PRL, H4-RET, IGH-IGK, and MYL-RAR. In some embodiments, the AD is an epitope of a viral antigen. In some embodiments, the AD is an epitope of the Epstein Barr virus antigen EBVA. In other embodiments, the AD is an epitope of the human papillomavirus (HPV) antigen E6 or E7. In some embodiments, the AD is an epitope of a large, protein-based antigen.

In some embodiments, the AD (e.g., in an Adapter and/or on a target cell) is an epitope of a hematological tumor antigen. In some embodiments, the AD is an epitope of an antigen selected from: BCMA, CD19, CD20, CD22, CD30, CD138, CD33, CD38, CD123, CS1, ROR1, Lewis$^Y$, Ig kappa light chain, TCR, BCMA, TACI, BAFFR (CD268), and a NKG2DL ligand.

In some embodiments, the AD (e.g., in an Adapter and/or on a target cell) is an epitope of a solid tumor antigen. In some embodiments, the AD is an epitope of an antigen selected from: disialoganglioside (GD2), o-acetyl GD2, EGFRvIII, HER2 (ErbB2), VEGFR2, FAP, mesothelin, IL13Ra2 (glioma), cMET, PSMA, folate receptor alpha, L1CAM, carcinoembryonic antigen (CEA), and EGFR.

In some embodiments, the A1) (e.g., in an Adapter and/or on a target cell) is an epitope of an antigen selected from the group: CD137, PDL1, CTLA4, CD47, KIR, TNFRSF10B (DR5), TIM3, PD1, cMet, Glycolipid F77, EGFRvIII, HLAA2 (NY-ESO-1), LAG3, CD134 (OX40), HVEM, BTLA, TNFRSF25 (DR3), CD133, MAGE A3, PSCA, MUC1, CD44v6, CD44v6/7, CD44v7/8, IL11Ra, ephA2, CAIX, MNCAIX, CSPG4, MUC16, EPCAM (EGP2), TAG72, EGP40, ErhB receptor family, ErhB2 (HER2), ErbB3/4, RAGE1, GD3, FAR, Lewis$^Y$, NCAM, HLAA1/ MAGE1, MAGEA1, MAGEA3, MAGE-A4, B7H3, WT1, MelanA (MART1), HPV E6, HPV E7, thyroglobulin, tyrosinase, PSA, CLL1GD3, Tn Ag, FLT3, KIT, PRSS21, CD24, PDGFR-beta, SSEA4, prostase, PAP, ELF2M, ephB2, IGF1, IGFII, IGFI receptor, LMP2, gp100, her-ab1, Fucosyl GM1, sLe, GM3, TGS5, folate receptor beta, TEM1. (CD248), TEM7R, CLDN6, TSHR, GPRC5D, CXORF61, CD97, CD7a, HLE, CD179a, ALK, Plysialic acid, PLAC1, GloboH, NY-BR-1, UPK2, HAVCR1, ADRB3, PANX3, GPR20, LY6K, OR51E2, TARP, LAGE1a, legumain, E7, ETV6-AML, sperm protein 17, XAGE1, Tie 2, MAD-CT1, MAD-CT2, Fos-related antigen 1, p53, p53 mutant, prostein, survivin, telomerase, PCTA1 (Galectin 8), Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP2, CYP1B1, BORIS, SART3, PAX5, OY-TES1, LCK, AKAP4, SSX2, reverse transcriptase, RU1, RU2, intestinal carboxyl esterase, neutrophil elastase, mut hsp70-2, CD79a, CD79b, CD72, LAIR1, FCAR, LILRA2, CD300LF, CLEC12A, BST2, EMR2, LY75, GPC3, FCRLS, IGLL1, TSP-180, MAGE4, MAGE5, MAGE6, VEGFR1, IGF1R, hepatocyte growth factor receptor, p185ErbB2, p180ErbB-3, nm-23H1, CA 19-9, CA 72-4, CAM 17.1, NuMa, K-ras, beta-Catenin, CDK4, Mum1, p15, p16, 43-9F, 5T4, 791Tgp72, β-human chorionic gonadotropin, BCA225, BTAA, CA125, CA15-3, CA 27.29 (BCAA), CA195, CA242, CA-50, CAM43, CD68, CO-029, FGF5, G250, HTgp-175, M344, MA50, MG7-Ag, MOV18, NB/70K, NY-CO1, RCAS1, SDCCAG16, M2BP, TAAL6, TLP, and TPS, glioma-associated antigen, alpha-fetoprotein (AFP), a p26 fragment of AFP, or variants thereof, lectin-reactive AFP, and TLR4.

In some embodiments, the AD (e.g., in an Adapter and/or on a target cell) is an epitope of a TSA or TAA. In some embodiments the AD is an epitope of an antigen selected from: PTGER4, ITGA4, CD37, CD52, CD62L (L-selectin), CXCR4, CD69, EVI2B (CD361), SLC39A8, MICB, LRRC70, CLELC2B, HMHA1, LST1, and CMTM6 (CKLFSF6). In some embodiments the AD is an epitope of BCMA. In some embodiments the AD is an epitope of CS1.

In some embodiments, the AD (e.g., in an Adapter and/or on a target cell) is an epitope of an antigen selected from: PDGFRA, VEGFR1, VEGFR3, neuropilin 1 (NRP1), neuropilin 2 (NRP2), betacellulin, PLGF, RET (rearranged during transfection), TIE1, TIE2 (TEK), CA125, CD3, CD4, CD7, CD10, CD13, CD25 CD32, CD32b, CD44 (e.g., CD44v6), CD47, CD49e (integrin alpha 5), CD54 (ICAM), CD55, CD64, CD74, CD80, CD90, CD200, CD147, CD166, CD200, ESA, SHH, DHH, IHH, patched 1 (PTCH1), smoothened (SMO), WNT1, WNT2B, WNT3A, WNT4, WNT4A, WNT5A, WNT5B, WNT7B, WNT8A, WNT10A, WNT10B, WNT16B, LKP5, LRP5, LRP6, FZD1, FZD2, FZD4, FZD5, FZD6, FZD7, FZD8, Notch, Notch1, Notch3, Notch4, DLL4, Jagged, Jagged1, Jagged2, Jagged3, TNFRSF1A (TNFR1, p55, p60), TNFRSF1B (TNFR2), TNFRSF6 (Fas, CD95), TNFRSF6B (DcR3), TNFRSF7 (CD27), TNFSF9 (41BB Ligand), TNFRSF8 (CD30), TNFRSF10A (TRAILR1, DR4), TNFRSF11A (RANK), TNFRSF12 (TWEAKR), TNFRSF19L (KELT), TNFRSF19 (TROY), TNFRSF21 (DR6), ILIRI, IL1R2, IL2R, IL5R, IL6R, IL8R, IL10R, IL12R, IL13R, IL15R, IL18R, IL19R, IL21R, IL23R, XAG1, XAG3, REGIV, FGFR1, FGFR2, FGFR3, ALK, ALK1, ALK7, ALCAM, Ax1, TGFb, TGFb2, TGFb3, TGFBR1, IGFIIR, BMPRI, N-cadherin, E-cadherin, VE-cadherin, ganglioside GM2, ganglioside GD3, PSGR, DCC, CDCP1, CXCR2, CXCR7, CCR3, CCR4, CCR5, CCR7, CCR10, Claudin1, Claudin2, Claudin3, Claudin4, TMEFF2, neuregulin, MCSF, CSF, CSFR (fms), GCSF, GCSFR, BCAM, BRCA1, BRCA2, HLA-DR, ABCC3, ABCB5, HM 1.24, LFA1, LYNX, S100A8, S100A9, SCF, Von Willebrand factor, Lewis Y6 receptor, CA G250 (CA9), CRYPTO, VLA5, HLADR, MUC18, mucin CanAg, EGFL7, integrin avb3, integrin α5β activin B1 alpha, leukotriene B4 receptor (LTB4R), neurotensin NT receptor (NTR), 5T4 oncofetal antigen, Tenascin C, MMP, MMP2, MMP7, MMP9, MMP12, MMP14, MMP26, cathepsin G, SULF1, SULF2, MET, CA9, TM4SF1, syndecan (SDC1), Ephrin B4, TEM1, TGFbeta 1, and TGFBRII.

In some embodiments, the AD (e.g., in an Adapter and/or on a target cell) is an epitope of an antigen associated with an autoimmune disorder, associated with an inflammatory or other disorder of the immune system, or is associated with regulating an immune response.

In some embodiments, the AD (e.g., in an Adapter and/or on a target cell) is an epitope of an immunoinhibitory target. In another embodiment, the AD is an epitope of an immunoinhibitory target selected from: IL1Ra, IL6R, CD26L, CD28, CD80, FcGamma RIIB. In another embodiment, the AD in the Adapter is an epitope of an immunostimulatory target selected from: CD25, CD28, CTLA4, PD1, B7H1 (PDL1), B7H4 TGFbeta, TNFRSF4 (OX40), TNFRSF5 (CD40), TNFRSF9 (41BB, CD137), TNFRSF14 (HVEM), TNFRSF25 (DR3), and TNFRSF18 (GITR).

In some embodiments, the AD (e.g., in an Adapter and/or on a target cell) is an epitope of a target selected from: IL1Rb, C3AR, C5AR, CXCR1, CXCR2, CCR1, CCR3, CCR7, CCR8, CCR9, CCR10, ChemR23, MPL, GP130, TLR2, TLR3, TLR4, TLR5, TLR7, TLR8, TLR9, TREM1, TREM2, CD49a (integrin alpha 1), integrin a5b3, alpha4 integrin subunit, A4B7 integrin, cathepsin G, TNFRSF3 (LTBR), TNFRSF6 (Fas, CD95), TNFRSF6B (DcR3), TNFRSF8 (CD30), TNFRSF11A (RANK), TNFRSF16 (NGFR), TNFRSF19L (RELT), TNFRSF19 (TROY), TNFRSF21 (DR6), CD14, CD23, CD36, CD36L, CD39, CD91, CD153, CD164, CD200, CD200R, B71 (CD80), B72 (CD86), B7h, B7DC (PDL2), ICOS, ICOSL, MHC, CD, B7H2, B7H3, B7x, SLAM, KIM1, SLAMF2, SLAMF3, SLAMF4, SLAMF5, SLAMF6, SLAMF7, TNFRSF1A (TNFR1, p55, p60), TNFRSF1B (TNFR2), TNFRSF7 (CD27), TNFRSF12 (TWEAKR), TNFRSF5 (CD40), IL1R, IL2R, IL4Ra, IL5R, IL6RIL15R, IL17R, IL17Rb, IL17RC, IL22RA, IL23R, TSLPR, B7RP1, cKit, GMCSF, GMCSFR, CD2, CD4, CD11a, CD18, CD30, CD40, CD86, CXCR3, CCR2, CCR4, CCR5, CCR8, RhD, IgE, and Rh.

In some embodiments, the AD (e.g., in an Adapter and/or on a target cell) is an epitope of an antigen associated with a neurological disorder.

In some embodiments, the AD (e.g., in an Adapter and/or on a target cell) is an epitope of a target selected from: amyloid beta (Abeta), beta amyloid, PLP, ROBO4, ROBO, LINGO, gpIIB, gpIIIa, integrin a2bB3, AOC3, TNFRSF19L (RELT), TNFRSF19 (TROY), and sclerostin.

The above targets and those otherwise described herein are intended to be illustrative and not limiting.

In some embodiments, the AD (e.g., in an Adapter and/or on a target cell) is bound by a chimeric antigen receptor (CAR). In some embodiments, the AD is bound by a cell expressing a chimeric antigen receptor. In some embodiments, the AD is bound by a scFv. In some embodiments, the AD is bound by an alternative scaffold binding domain (ASBD). In some embodiments, the AD is bound by a D domain. In some embodiments, the AD is bound by an antibody or an antigen-binding fragment thereof.

III. Antigenic Determinant Binding Domains (ADBDs)

A protein domain that binds to an antigenic determinant (AD) (e.g., as described in Section II and Section XI) is referred to herein as an "antigenic-determinant binding domain" or "ADBD." In some embodiments, the ADBD is sufficient to confer recognition and specific binding to a target of interest. The ADBD described herein can be present in an Adapter (e.g., as described in Section V and Section XI) and/or in a chimeric antigen receptor (CAR) (e.g., as described in Section VI and Section XI).

The target of interest specifically bound by the ADBD (e.g., of an Adapter and/or CAR) can be any molecule for which it is desirable for an Adapter and/or CAR to bind, e.g., any of the ADs described herein (e.g., as described in Section II and Section XI). In some embodiments, the target(s) specifically bound by the ADBD can be any target of purification, manufacturing, formulation, therapeutic, diagnostic, or prognostic relevance or value. In some embodiments, the target of the ADBD can be naturally occurring or synthetic. In some embodiments, the target of the ADBD can be an extracellular component, an intracellular component, a soluble factor (e.g., an enzyme, hormone, cytokine, growth factor, toxin, venom, pollutant, etc.), or a transmembrane protein (e.g., a cell surface receptor).

In one embodiment, the ADBD (e.g., of an Adapter and/or CAR) specifically binds a target of interest on the surface of a target cell. In some embodiments, the ADBD specifically binds a cell surface receptor. In some embodiments, the ADBD specifically binds a target of interest that is a member of a family selected from: a phosphatase receptor, growth factor receptor, a tyrosine kinase receptor, a TNF family receptor, a G-protein-coupled receptor, and a chemokine receptor. In some embodiments, the ADBD binds multiple members of the same family (e.g., the TNF receptors TRAILR1 and TRAILR2). In some embodiments, the ADBD binds members from different families Thus, for example, in some embodiments, the ADBD can bind to a growth factor receptor and a TNF receptor or a G-protein-coupled receptor and a chemokine receptor.

In some embodiments, the ADBD (e.g., of an Adapter and/or CAR) binds to a tumor antigen. In some embodiments, the ADBD binds to a tumor-associated antigen. In some embodiments, the ADBD binds to a tumor-specific antigen.

In some embodiments, the ADBD (e.g., of an Adapter and/or CAR) binds a cancer antigen. In some embodiments, the ADBD binds to a cancer-associated antigen. In some embodiments, the ADBD binds to a cancer-specific antigen.

In some embodiments, the ADBD (e.g., of an Adapter and/or CAR) binds an antigen expressed on the surface of an immune effector cell.

In some embodiments, a target of interest bound by the ADBD (e.g., of an Adapter and/or CAR) is a human protein. In one embodiment, the ADBD binds a human protein target of interest and its monkey (e.g., cynomolgus monkey), mouse, rabbit, hamster and/or a rabbit ortholog.

In another embodiment, the ADBD (e.g., of an Adapter and/or CAR) binds a peptide tag present on a target of interest. Such peptide tags provide a useful means by which to detect, monitor, and/or attach one or more additional moieties to the Adapter. In one embodiment, the ADBD specifically binds a peptide tag selected from: a hexahistidyl (His6) tag, a myc tag, and a FLAG tag. Other peptide tags are described herein or otherwise known in the art.

Affinity requirements for a given ADBD binding event are contingent on a variety of factors including, but not limited to: the composition and complexity of the binding matrix, the valency and density of both the ADBD and target molecules, and the functional application of the ADBD. In one embodiment, the ADBD binds a target of interest with a dissociation constant (KD) of less than or equal to $5\times10^{-3}$ M, $10^{-3}$ M, $5\times10^{-4}$ M, $10^{-4}$ M, $5\times10^{-5}$ M, or $10^{-5}$ M. In an additional embodiment, the ADBD binds a target of interest with a KD of less than or equal to $5\times10^{-6}$ M, $10^{-6}$ M, $5\times10^{-7}$ M, $10^{-7}$M, $5\times10^{-8}$M, or $10^{-8}$ M. In additional embodiments, a the ADBD binds a target of interest with a KD less than or equal to $5\times10^{-9}$M, $10^{-9}$M, $5\times10^{-10}$M, $10^{-10}$ M, $5\times10^{-11}$ M, $10^{-11}$ M, $5\times10^{-12}$M, $10^{-12}$ M, $5\times10^{-13}$ M, $10^{-13}$ M, $5\times10^{-14}$ M, $10^{-14}$ M, $5\times10^{-15}$ M, or $10^{-15}$ M. In several embodiments, the ADBD generated by the methods disclosed herein have a dissociation constant selected from the group: between $10^{-4}$ M and $10^{-5}$ M, between $10^{-5}$ M and $10^{-6}$ M, between $10^{-6}$ M and $10^{-7}$ M, between $10^{-7}$ M and $10^{-8}$ M, between $10^{-8}$ M and $10^{-9}$ M, between $10^{-9}$ M and $10^{10}$ M, between $10^{10}$ M and $10^{-11}$ M and between $10^{-11}$ M and $10^{-12}$ M.

In one embodiment the ADBD binds a target of interest in active form. In one embodiment the ADBD reversibly binds a target of interest in active form and also releases the bound target in active form. In one embodiment the ADBD binds a target of interest in the native form. In specific embodiments, the ADBD bind targets of interest with off-rates or Koff of greater than or equal to $10^{-10}$ sec$^{-1}$, $5\times10^{-9}$ sec$^{-1}$, $10^{-9}$ sec$^{-1}$, $5\times10^{-8}$ sec$^{-1}$, $10^{-8}$ sec$^{-1}$, $5\times10^{-7}$ sec$^{-1}$, $10^{-7}$ sec$^{-1}$, $5\times10^{-6}$ sec$^{-1}$, $10^{-6}$ sec$^{-1}$, $5\times10^{-5}$ sec$^{-1}$, $10^{-5}$ sec$^{-1}$, $5\times10^{-4}$ sec$^{-1}$, $10^{-4}$ sec$^{-1}$, $5\times10^{-3}$ sec$^{-1}$, $10^{-3}$ sec$^{-1}$, $5\times10^{-2}$ sec$^{-1}$, $10^{-2}$ sec$^{-1}$, $5\times10^{-1}$ sec$^{-1}$, or $10^{-1}$ sec$^{-1}$.

Binding experiments to determine KD and off-rates can be performed in a number of conditions including, but not limited to, [pH 6.0, 0.01% Tween 20], [pH 6.0, 0.1% gelatin], [pH5.0, 0.01% Tween 20], [pH9.0, 0.1% Tween 20], [pH6.0, 15% ethylene glycol, 0.01% Tween 20], [pH5.0, 15% ethylene glycol, 0.01% Tween 20], and [pH9.0, 15% ethylene glycol, 0.01% Tween 20]. The buffers in which to make these solutions can readily be determined by one of skill in the art, and depend largely on the desired pH of the final solution. Low pH solutions (<pH 5.5) can be made, for example, in citrate buffer, glycine-HCl buffer, or in succinic acid buffer. High pH solutions can be made, for example, in Tris-HCl, phosphate buffers, or sodium bicarbonate buffers. A number of conditions may be used to determine KD and off-rates for the purpose of determining, for example, optimal pH and/or salt concentrations.

In one embodiment, the ADBD specifically binds a target of interest with a KOff ranging from 0.1 to $10^{-7}$ sec$^{-1}$, $10^{-2}$ to $10^{-7}$ sec$^{-1}$, or $0.5\times10^{-2}$ to $10^{-7}$ sec$^{-1}$. In a specific embodiment, the ADBD binds a target of interest with an off rate (KOff) of less than $5\times10^{-2}$ sec$^{-1}$, $10^{-2}$ sec$^{-1}$, $5\times10^{-3}$ sec$^{-1}$, or $10^{-3}$ sec$^{-1}$. In an additional embodiment, the ADBD binds a target of interest with an off rate ($K_{off}$) of less than $5\times10^{-4}$ sec$^{-1}$, $10^{-4}$ sec$^{-1}$, $5\times10^{-5}$ sec$^{-1}$, or $10^{-5}$ sec$^{-1}$, $5\times10^{-6}$ sec$^{-1}$, $10^{-6}$ sec$^{-1}$, $5\times10^{-7}$ sec$^{-1}$, or $10^{-7}$ sec$^{-1}$.

In one embodiment, the ADBD specifically binds a target of interest with a KOn ranging from $10^3$ to $10^7$ M$^{-1}$sec$^{-1}$, $10^3$ to $10^6$ M$^{-1}$sec$^{-1}$, or $10^3$ to $10^5$ M$^{-1}$sec$^{-1}$. In other specific embodiments, the ADBD binds the target of interest its target of interest with an on rate (KOn) of greater than $10^3$ M$^{-1}$sec$^{-1}$, $5\times10^3$ M$^{-1}$sec$^{-1}$, $10^4$ M$^{-1}$sec$^{-1}$, or $5\times10^4$ M$^{-1}$sec$^{-1}$. In an additional embodiment, the ADBD binds a target of interest with a KOn of greater than $10^5$M$^{-1}$sec$^{-1}$, $5\times10^5$ M$^{-1}$sec$^{-1}$, $10^6$ M$^{-1}$sec$^{-1}$, or $5\times10^6$ M$^{-1}$sec$^{-1}$, or $10^7$ M$^{-1}$ sec$^{-1}$.

In some embodiments, the ADBD (e.g., of an Adapter and/or CAR) is an antibody or an antigen-binding fragment thereof. In some embodiments, the ADBD is a scFv. In some embodiments, the ADBD is an alternative scaffold binding domain. In some embodiments, the ADBD is a D domain.

IIIa. Antibody-Derived Antigenic Determinant Binding Domains (ADBD)

In some embodiments, one or more ADBDs (e.g., of an Adapter and/or CAR) can be derived from an antibody molecule, e.g., one or more of monoclonal antibodies, polyclonal antibodies, recombinant antibodies, human antibodies, humanized antibodies, single-domain antibodies e.g., a heavy chain variable domain (VH), a light chain variable domain (VL) and a variable domain (VHH) from, e.g., human or camelid origin. In some embodiments, the ADBD is derived from the same species in which the Adapter or CAR will ultimately be used, e.g., for use in humans. It may be beneficial for Adapter and/or CAR to comprise a human or a humanized ADBD. Compositions and techniques for routinely generating such ADBDs are known in the art.

In some embodiments, the ADBD (e.g., of an Adapter and/or CAR) comprises a fragment of an antibody that is sufficient to confer recognition and specific binding to the target antigen. Examples of an antibody fragment include, but are not limited to, an Fab, Fab', F(ab')$_2$, or Fv fragment, an scFv antibody fragment, a linear antibody, single domain antibody such as an sdAb (either VL or VH), a camelid VHH domain, and multi-specific antibodies formed from antibody fragments.

In some embodiments, the ADBD (e.g., of an Adapter and/or CAR) is a "scFv," which can comprise a fusion protein comprising a VL chain and a VH chain of an antibody, wherein the VH and VL are, e.g., linked via a short flexible polypeptide linker, e.g., a linker described herein. scFvs can routinely be prepared according to methods known in the art (see, e.g., Bird et al., Science 242: 423-426 (1988) and Huston et al., Proc. Natl. Acad. Sci. USA 85: 5879-5883 (1988)).

In some embodiments, the ADBD (e.g., of an Adapter and/or CAR) is a single domain antigen binding (SDAB) molecule. A SDAB molecule includes molecules containing complementary determining regions that are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules can be derived from any species including, but not limited to mouse, human, camel, llama, fish, shark, goat, rabbit, and bovine. This term also includes naturally occurring single domain antibody molecules from species other than Camelidae and sharks.

In some embodiments, the ADBD (e.g., of an Adapter and/or CAR) comprises a human antibody or a fragment thereof. In some embodiments, the ADBD (e.g., of an Adapter and/or CAR) comprises a humanized antibody or a fragment thereof.

Humanization of antibodies is well-known in the art and can essentially be performed following the method of Winter and co-workers (Jones et al., Nature 321: 522-525 (1986); Riechmann et al., Nature 332: 323-327 (1988); Verhoeyen et al., Science 239: 1534-1536 (1988)), by substituting rodent CDRs or CDR sequences for the corresponding sequences of a human antibody, i.e., CDR-grafting (EP 239,400; Intl. Appl. Publ. No. WO 91/09967; and U.S. Pat. Nos. 4,816, 567; 6,331,415; 5,225,539; 5,530,101; 5,585,089; and 6,548,640; the contents of which are incorporated herein by reference herein in their entirety). Humanization of antibodies can also be achieved by veneering or resurfacing (EP 592,106; EP 519,596; Padlan, 1991, Molecular Immunology, 28(4/5): 489-498; Studnicka et al., Protein Engineering 7(6): 805-814 (1994); and Roguska et al., PNAS 91: 969-973 (1994)) or chain shuffling (U.S. Pat. No. 5,565,332), the contents of which are incorporated herein by reference herein in their entirety.

IIIb. Alternative Scaffold Binding Domains

In some embodiments, the ADBD(s) (e.g., of an Adapter and/or CAR) is an alternative scaffold binding domain (ASBD). An "alternative scaffold binding domain" or "ASBD" as used herein, is an antigen determinant binding domain that is derived from, or corresponds to, a non-antibody-based binding scaffold.

In some embodiments, the disclosure provides a CAR comprising an ADBD that is an ASBD. In some embodiments, the disclosure provides a cell comprising a CAR that comprises an ADBD that is an ASBD. In further embodiments, an immune effector cell that comprises a CAR comprising and ASBD is provided. In some embodiments, the disclosure provides an Adapter comprising an ADBD that is an ASBD.

In further embodiments, the disclosure provides a composition comprising an Adapter and a CAR that each comprise an ASBD.

In some embodiments, the binding of the ASBD (e.g., of an Adapter and/or CAR) to the target AD is mediated by secondary structures of the binding scaffold, such as alpha helices or beta sheets. In some embodiments, the ASBD is a three-helix bundle-based binding domain. In some embodiments, the ASBD is a D domain-based binding domain. In other embodiments, the ASBD is a Z-domain (Affibody)-based binding domain.

In some embodiments, the ASBD (e.g., of an Adapter and/or CAR) is a D domain (de novo binding domain)-based AD binding domain. The D domain scaffold-based binding domain generally consists of 70-75 amino acid residues in which substitutions of up to 20 positions corresponding to structurally constrained surface-exposed residues in a non-naturally occurring antiparallel three helical bundle reference scaffold (SEQ ID NO: 1) confer target recognition and binding specificity for the target (AD) of interest. D domain scaffold-based binding domains are further disclosed in Intl. Appl. Publ. No. WO2016164308, the contents of which are herein incorporated by reference in their entirety. In one embodiment, the D domain comprises an amino acid sequence that differs (e.g., due to amino acid modifications) from that of a reference scaffold having the sequence of SEQ ID NO: 1 by up to 20 substitutions. In some embodiments, the D domain comprises a sequence selected from the group: SEQ ID NO: 17, 18, and 19. In some embodiments, the D domain comprises a sequence selected from the group: SEQ ID NO: 20-26, and 27. In further embodiments, the D domain comprises a sequence selected from the group: SEQ ID NO: 44-1078 and 1079.

In some embodiments the ASBD (e.g., of an Adapter and/or CAR) is a Z-domain scaffold (Affibody)-based AD binding domain Z-domain scaffold-based binding domains generally consist of 58 amino acid residues in which substitutions of up to 13 positions located in the first and second of three alpha helices, confer binding confer target (AD) recognition and binding specificity for the target (AD) of interest. In further embodiments, the Z-domain ASBD comprises a sequence selected from SEQ ID NO: 28 and 29. Z-domain (Affibody) scaffold-based binding domains are further described in U.S. Pat. No. 5,831,012, the entire contents of which are herein incorporated by reference in their entirety.

Additional examples of ASBDs that display secondary structure-mediated target binding include DARPins, affilins, and armadillo repeat-based binding scaffolds.

In some embodiments, the ASBD (e.g., of an Adapter and/or CAR) is a DARPin-based AD binding domain DARPin-based binding domains generally contain 2-3 repeats of the sequence of SEQ ID NO: 30 positioned between N- and C-terminal capping repeats (e.g., the sequence MRGSHHHHHHGSDLGKKLLEAARAGQDDEVRIL-MANGA DVNAX$_{33}$ (SEQ ID NO: 31) and the sequence QDKFGKTAFDISIDNGNEDLAEILQ (SEQ ID NO: 32), respectively, wherein the first Gln corresponds to consensus repeat position X$_{33}$ of the preceding repeat). Each internal repeat consists of 27 framework residues and up to 6 substituted non-framework residues that that form a β-turn followed by two antiparallel helices and a loop that connects to the β-turn of the next repeat. The collective substitutions and structure of the DARPin confers target (AD) recognition and binding specificity.

TABLE 1

Exemplary secondary structure-based ASBD Sequences

| ADBD | Sequence |
| --- | --- |
| D-domain F1 | MGSWX$_5$X$_6$FKX$_9$X$_{10}$LAX$_{13}$IKX$_{16}$X$_{17}$LEALGGSEAELAX$_{30}$FE X$_{33}$X$_{34}$IAX$_{37}$FEX$_{40}$X$_{41}$LQX$_{44}$YKGKGNPEVEALRKEAAAIRD ELQAYRHN (SEQ ID NO: 17) |

TABLE 1-continued

Exemplary secondary structure-based ASBD Sequences

| ADBD | Sequence |
| --- | --- |
| D-domain F2 | MGSWAEFKQRLAAIKTRLEALGGSEAELAAFX$_{32}$X$_{33}$EIX$_{36}$ AFX$_{39}$X$_{40}$ELX$_{43}$AYKGKGNPEVEALX$_{57}$X$_{58}$EAX$_{61}$AIX$_{64}$X$_{65}$ ELX$_{68}$AYRHN (SEQ ID NO: 18) |
| D-domain F3 | MGSWX$_5$EFX$_8$X$_9$RLX$_{12}$AIX$_{15}$X$_{16}$RLX$_{19}$ALGGSEAELAAFEK EIAAFESELQAYKGKGNPEVEX$_{55}$LRX$_{58}$X$_{59}$AAX$_{62}$IRX$_{65}$ X$_{66}$LQAYRHN (SEQ ID NO: 19) |
| D-domain C1 | MGSWX$_5$X$_6$FKX$_9$X$_{10}$LAX$_{13}$IKX$_{16}$X$_{17}$LEALGGSEAELAAFX$_{32}$ X$_{33}$EIX$_{36}$AFX$_{39}$X$_{40}$ELX$_{43}$AYKGKGNPEVEX$_{55}$LRX$_{58}$X$_{59}$AA X$_{62}$IRX$_{65}$X$_{66}$LQAYRHN (SEQ ID NO: 20) |
| D-domain C2 | MGSWX$_5$EFX$_8$X$_9$RLX$_{12}$AIX$_{15}$X$_{16}$RLX$_{19}$ALGGSEAELAX$_{30}$FE X$_{33}$X$_{34}$IAX$_{37}$FEX$_{40}$X$_{41}$LQX$_{44}$YKGKGNPEVEALX$_{57}$X$_{58}$EA X$_{61}$AIX$_{64}$X$_{65}$ELX$_{68}$AYRHN (SEQ ID NO: 21) |
| D-domain FILpx | MGSWX$_5$X$_6$FKX$_9$X$_{10}$LAX$_{13}$IKX$_{16}$X$_{17}$LEALZ$_1$EAELAX$_{28}$FE X$_{31}$X$_{32}$IAX$_{35}$PEX$_{38}$X$_{39}$LQX$_{42}$YZ$_2$NPEVEALRKEAAAIRD ELQAYRHN (SEQ ID NO: 22) |
| D-domain F2Lpx | MGSWAEFKQRLAAIKTRLEALZ$_1$EAELAAFX$_{30}$X$_{31}$EIX$_{34}$A FX$_{37}$X$_{38}$ELX$_{41}$AYZ$_2$NPEVEALX$_{52}$X$_{53}$EAX$_{56}$AIX$_{59}$X$_{60}$EL X$_{63}$AYRHN (SEQ ID NO: 23) |
| D-domain F3Lpx | MGSWX$_5$EFX$_8$X$_9$RLX$_{12}$AIX$_{15}$X$_{16}$RLX$_{19}$ALZ$_1$EAELAAFEKE IAAFESELQAYZ$_2$NPEVEX$_{50}$LRX$_{53}$X$_{54}$AAX$_{57}$IRX$_{60}$X$_{61}$LQ AYRHN (SEQ ID NO: 24) |
| D-domain C1Lpx | MGSWX$_5$X$_6$FKX$_9$X$_{10}$LAX$_{13}$IKX$_{16}$X$_{17}$LEALZ$_1$EAELAAFX$_{30}$ X$_{31}$EIX$_{34}$AFX$_{37}$X$_{38}$ELX$_{41}$AYZ$_2$NPEVEX$_{50}$LRX$_{53}$X$_{54}$AAX$_{57}$ IRX$_{60}$X$_{61}$LQAYRHN (SEQ ID NO: 25) |
| D-domain C2Lpx | MGSWX$_5$EFX$_8$X$_9$RLX$_{12}$AIX$_{15}$X$_{16}$RLX$_{19}$ALZ$_1$EAELAX$_{28}$FE X$_{31}$X$_{32}$IAX$_{35}$PEX$_{38}$X$_{39}$LQX$_{42}$YZ$_2$NPEVEALX$_{52}$X$_{53}$EAX$_{56}$A IX$_{59}$X$_{60}$ELX$_{63}$AYRHN (SEQ ID NO: 26) |
| D-domain DD-WTF | MGSWX$_5$EFX$_8$X$_9$RLX$_{12}$X$_{13}$IX$_{15}$X$_{16}$RLX$_{19}$ALGGSEAELAAF EKEIX$_{36}$AFX$_{39}$X$_{40}$ELX$_{43}$AYKGKGNPEVEALRX$_{58}$EAX$_{61}$ X$_{62}$IRX$_{65}$ELX$_{68}$X$_{69}$YRX$_{72}$X$_{73}$ (SEQ ID NO: 27) |
| Z-Domain AFFa | VDNKFNKEX$_9$X$_{10}$X$_{11}$AX$_{13}$X$_{14}$EIX$_{17}$X$_{18}$LPNLNX$_{24}$X$_{25}$QX$_{27}$ X$_{28}$AFIX$_{32}$SLX$_{35}$DDPSQSANLLAEAKKLNDAQAPK (SEQ ID NO: 28) |
| Z-Domain AFFb | NKEX$_4$X$_5$X$_6$AX$_8$X$_9$EIX$_{12}$X$_{13}$LPNLNX$_{19}$X$_{20}$QX$_{22}$X$_{23}$AFIX$_{27}$ SLX$_{30}$DDP (SEQ ID NO: 29) |
| DARPin | DX$_2$X$_3$GX$_5$TPLHLAAX$_{13}$X$_{14}$GHLEIVEVLLKZ$_{26}$GADVNAX$_{33}$ (SEQ ID NO: 30) wherein X is any amino acid but C, R or P and Z is H, N, or Y. |

X = all amino acid residues, including natural and non-natural amino acids
Z = amino acid sequence corresponding to loop1 (Z$_1$) or loop2 (Z$_2$) as described herein, comprising between about 2 to about 30 natural or non-natural amino acids In some embodiments, the binding specificity of the ASBD (e.g., of an Adapter and/or CAR) to the target AD is mediated by amino acids in exposed loops on the ASBD. Examples of scaffolds having these binding properties include, adnectins, lipocalins, avimers, knottins, fynomers, atrimers, kunitz domain-based binders, and CTLA4-based binding scaffolds.

In some embodiments, the ASBD is an adnectin-based AD binding domain. The adnectin-based binding domain is derived from the tenth domain of fibronectin type III (10Fn3). This ADBD is generally a 94 amino acid binding domain that adopts a beta sandwich fold containing seven strands that are connected by six loops. Substitutions in three surface-exposed loops on one side of the adnectin domain generate target (AD) specific binding moieties.

In some embodiments, the ASBD (e.g., of an Adapter and/or CAR) is a lipocalin-, affilin-, or anticalin-based AD-binding domain. The anticalin scaffold displays a conserved β-barrel structure made up of eight anti-parallel β-strands and generally consists of 160-180 amino acids. The ligand binding pocket of the anticallin-based binding scaffold is composed of four loops, each containing up to 24 substitutions, that collectively confer target (AD) recognition and binding specificity.

In some embodiments, the ASBD (e.g., of an Adapter and/or CAR) is an Avimer scaffold-based AD-binding domain Avimer scaffold-based binding domains are derived from the A-domain of cell surface receptors and are generally 35 amino acids in length. The structure of the Avimer-based binding domain is maintained by 12 conserved amino acids. Substitutions of up to all of the remaining 23 residues of the binding domain confer target (AD) recognition and binding specificity. In some embodiments, the Avimer scaffold-based binding domain comprises the sequence EFX$_3$CX$_5$NGX$_8$CIPX$_{12}$X$_{13}$WX$_{15}$CDGX$_{19}$DDCGDX$_{25}$SDE, wherein X is any amino acid (SEQ ID NO: 33). Avimer scaffold-based binding domains are further described in U.S. Appl. Publ. Nos. 20040175756, 20050053973, 20050048512, and 20060008844, the entire contents of each of which are herein incorporated by reference in their entireties.

In some embodiments, the ASBD (e.g., of an Adapter and/or CAR) is a fynomer scaffold-based AD binding domain. The fynomer binding domain is generally 60-75 amino acids in length and is composed of a pair of anti-parallel beta sheets joined by two flexible loops. Substitutions/insertions in the loops confer AD target recognition and binding specificity. In some embodiments, the fynomer-based AD binding domain comprises the sequence GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEKFQILSTHEYEX$_{41}$X$_{42}$X$_{43}$X$_{44}$X$_{45}$X$_{46}$X$_{47}$X$_{48}$WEARSLTTGETGX$_{61}$IPSNYVAPVDSIQ, wherein X is any amino acid residue and X$_{13}$-X$_{21}$ and X$_{42}$-X$_{46}$, are optionally absent (SEQ ID NO: 34). In some embodiments, the fynomer-based AD binding domain comprises the sequence GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEKFQILSTHEYEDWWEARSLTTGETGYIPSNYVAPVDSIQ, wherein X is any amino acid residue and X$_{16}$-X$_{21}$ and are optionally absent (SEQ ID NO: 35).

In some embodiments the ASBD (e.g., of an Adapter and/or CAR) is a knottin scaffold-based AD binding domain Knottin scaffold-based binding domains correspond to a 30-amino-acid protein fold composed of three anti-parallel β-strands connected by loops of variable length and multiple disulfide bonds.

In some embodiments the ASBD (e.g., of an Adapter and/or CAR) is a Kunitz domain-based AD binding domain. Kunitz domain-based binding domains are derived from the active motif of Kunitz-type protease inhibitors and are generally about 60 amino acids in length. The hydrophobic core of this ADBD is composed of a twisted two-stranded antiparallel β-sheet and two α-helices stabilized by three pairs of disulfide bonds. Substitutions and insertions in the three loops confer AD target recognition and binding specificity. In some embodiments, the Kunitz domain-based AD binding domain comprises the sequence MHSFCAFKADX$_{11}$GX$_{13}$C X$_{15}$X$_{16}$X$_{17}$X$_{18}$X$_{19}$RFFFNIFTRQCEEFX$_{34}$YGGCX$_{39}$X$_{40}$NQNRFESLEECKKMCTRDGA (SEQ ID NO: 36) sequence that is at least 85% identical to at positions other than X; X$_{11}$ is one of: A, D, E, F, G, H, I, K, L, M, N, P, Q, R, S, T, V, W, Y; X$_{13}$ is one of: A, D, E, F, G, H, I, K, L, M, N, P, Q, R, S, T, V, W, Y; X$_{15}$ is one of: A, D, E, F, G, H, I, K, L, M, N, Q, R, S, T, V, W, Y; X$_{16}$ is one of: A, G, E, D, H, T; X$_{17}$ is one of: A, D, E, F, G, H, I, K, L, M, N, Q, R, S, T, V, W, Y; X$_{18}$ is one of: A, D, E, F, G, H, I, K, L, M, N, Q, R, S, T, V, W, Y; X$_{19}$ is one of: A, D, E, F, G, H, I, K, L, M, N, P, Q, R, S, T, V, W, Y; X$_{34}$ is one of: A, C, D, E, F, G, H, I, K, L, M, N, P, Q, R, S, T, V, W, Y; X$_{39}$ is one of: A, C, D, E, F, G, H, I, K, L, M, N, P, Q, R, S, T, V, W, Y; and X$_{40}$ is one of: G, and A. Kunitz scaffold-based binding domains are further described in Intl. Appl. Publ. No. WO 2004063337, the entire contents of which are herein incorporated by reference in their entirety.

In some embodiments the ASBD (e.g., of an Adapter and/or CAR) is a WW domain-based AD-binding domain WW domain-based binding scaffolds are generally 30-35 amino acids in length. In some embodiments, the WW domain-based AD binding scaffold comprises the sequence KLPPGWX$_7$KX$_9$WSX$_{12}$X$_{13}$X$_{14}$GRVX$_{18}$YX$_{20}$NX$_{22}$ITX$_{25}$AX$_{27}$QWERP (SEQ ID NO: 37), wherein X$_7$, X$_9$, X$_{12}$, X$_{13}$, X$_{14}$, X$_{18}$, X$_{20}$, X$_{22}$, X$_{25}$, and X$_{27}$ represent any amino acid, and X$_{14}$ is optionally absent.

In some embodiments, the WW domain-based AD binding scaffold comprises the sequence KLPPGWX$_7$KX$_9$WSX$_{12}$X$_{13}$GRVX$_{17}$YX$_{19}$NX$_{21}$ITX$_{24}$AX$_{26}$QWERP (SEQ ID NO: 38), wherein X$_7$, X$_9$, X$_{12}$, X$_{13}$, X$_{17}$, X$_{19}$, X$_{21}$, X$_{24}$, and X$_{26}$ represent any amino acid, and X$_{14}$ is optionally absent.

TABLE 2

Exemplary loop-based ASBDs

| ASBD | Sequence |
|---|---|
| Avimer1 | EFX$_3$CX$_5$NGX$_8$CIPX$_{12}$X$_{13}$WX$_{15}$CDGX$_{19}$DDCGDX$_{25}$SDE (SEQ ID NO: 33) |
| Fynomer1 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFH KGEKFQILSTHEYEX$_{41}$X$_{42}$X$_{43}$X$_{44}$X$_{45}$X$_{46}$X$_{47}$X$_{48}$WEARSLTT GETGX$_{61}$IPSNYVAPVDSIQ wherein X = any amino acid residue and X$_{13}$-X$_{21}$ and X$_{42}$-X$_{46}$, are optionally absent (SEQ ID NO: 34) |
| Fynomer2 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFH KGEKFQILS<u>THEYED</u>WWEARSLTTGETGYIPSNYVAPVDS IQ wherein X$_{16}$-X$_{21}$ are optionally absent (SEQ ID NO: 35) |
| Kunitz1 | MHSFCAFKADX$_{11}$GXi3CX$_{15}$X$_{16}$X$_{17}$X$_{18}$X$_{19}$RFFFNIFTRQCE EFX$_{34}$YGGCX$_{39}$X$_{40}$NQNRFESLEECKKMCTRDGA (SEQ ID NO: 36) |
| WW1 | KLPPGWX$_7$KX$_9$WSX$_{12}$X$_{13}$X$_{14}$GRVX$_{18}$YX$_{20}$NX$_{22}$ITX$_{25}$AX$_{27}$QW ERP (SEQ ID NO: 37) |
| WW2 | KLPPGWX$_7$KX$_9$WSX$_{12}$X$_{13}$GRVX$_{17}$YX$_{19}$NX$_{21}$ITX$_{24}$AX$_{26}$QWERP (SEQ ID NO: 38) |

X = all amino acid residues

IV. Linkers

Linkers are peptide or other chemical linkages located between two or more otherwise independent functional domains of the Adapter or CAR.

Suitable linkers for operably linking two or more functional domains of the Adapter in a single-chain amino acid sequence include but are not limited to, polypeptide linkers such as glycine linkers, serine linkers, mixed glycine/serine linkers, glycine- and serine-rich linkers or linkers composed of largely polar polypeptide fragments.

In one embodiment, the linker is made up of a majority of amino acids selected from glycine, alanine, proline, asparagine, glutamine, and lysine. In one embodiment, one or more linkers in the Adapter or CAR is made up of a majority of amino acids selected from glycine, alanine, proline, asparagine, aspartic acid, threonine, glutamine, and lysine. In one embodiment, one or more linkers in the Adapter or CAR is made up of one or more amino acids selected from glycine, alanine, proline, asparagine, aspartic acid, threonine, glutamine, and lysine. In another embodiment, one or more linkers in the Adapter or CAR is made up of a majority of amino acids that are sterically unhindered. In another embodiment, a linker in which the majority of amino acids are glycine, serine, and/or alanine. In some embodiments, one or more linkers in an Adapter or CAR linker comprises polyglycines (such as $(Gly)_5$ (SEQ ID NO:1099), and $(Gly)_8$ (SEQ ID NO:1100), poly(Gly-Ala), and polyalanines. In some embodiments, the peptide linker contains the sequence of Gly-Gly-Gly-Gly-Thr-Gly-Gly-Gly-Gly-Ser (SEQ ID NO: 39). In some embodiments, one or more linkers in the Adapter or CAR comprises the sequence of Gly-Gly-Gly-Gly-Asp-Gly-Gly-Gly-Gly-Ser (SEQ ID NO: 40).

In one embodiment, the Adapter or CAR comprises an ADBD directly attached (i.e., without a linker) to another component of the Adapter or CAR, respectively. In one embodiment, the Adapter or CAR contains at least 2, at least 3, at least 4, or at least 5 ADBDs directly attached to another domain of the Adapter or CAR, respectively.

In another embodiment, an ADBD can be operably linked to another component of the Adapter or CAR through a linker. Adapters or CARs can contain a single linker, multiple linkers, or no linkers. In one embodiment, the Adapter or CAR comprises an ADBD operably linked to another component of the Adapter or CAR, respectively, through a linker peptide. In one embodiment, the Adapter or CAR contains at least 2, at least 3, at least 4, or at least 5 ADBDs operably linked to another domain of the Adapter or CAR, respectively, through the same or different linkers.

Linkers can be of any size or composition so long as they are able to operably link a functional domain of the Adapter or CAR in a manner that enables the functional domain to function (e.g., the ability of an antigenic determinant binding domain to bind a target of interest). In some embodiments, linker(s) are about 1 to about 100 amino acids, about 1 to 50 amino acids, about 1 to 20 amino acids, about 1 to 15 amino acids, about 1 to 10 amino acids, about 1 to 5 amino acids, about 2 to 20 amino acids, about 2 to 15 amino acids, about 2 to 10 amino acids, or about 2 to 5 amino acids. It should be clear that the length, the degree of flexibility and/or other properties of the linker(s) may have some influence on the properties of the final polypeptide of the invention, including but not limited to the affinity, specificity or avidity for a target of interest, or for one or more other target proteins of interest. When two or more linkers are used in the Adapter or CAR, these linkers may be the same or different. In the context and disclosure provided herein, a person skilled in the art will be able to routinely determine the optimal linker composition and length for the purpose of operably linking the functional domains of an Adapter or CAR.

The linker can also be a non-peptide linker such as an alkyl linker, or a PEG linker. For example, alkyl linkers such as —NH—(CH2)s-C(0)-, wherein s=2-20 can be used. These alkyl linkers may further be substituted by any non-sterically hindering group such as lower alkyl e.g., C1-C6) lower acyl, halogen (e.g., CI, Br), CN, NH2, phenyl, etc. An exemplary non-peptide linker is a PEG linker. In certain embodiments, the PEG linker has a molecular weight of about 100 to 5000 kDa, or about 100 to 500 kDa.

Suitable linkers for coupling Adapter or CAR functional domains by chemical cross-linking include, but are not limited to, homo-bifunctional chemical cross-linking compounds such as glutaraldehyde, imidoesters such as dimethyl adipimidate (DMA), dimethyl suberimidate (DMS) and dimethyl pimelimidate (DMP) or N-hydroxysuccinimide (NHS) esters such as dithiobis(succinimidylpropionate) (DSP) and dithiobis (sulfosuccini-midylpropionate) (DTSSP). Examples of suitable linkers for coupling Adapter or CAR functional domains include but are not limited to cross-linkers with one amine-reactive end and a sulfhydryl-reactive moiety at the other end, or with a NHS ester at one end and an SH-reactive group (e.g., a maleimide or pyridyl).

In additional embodiments, one or more of the linkers in the Adapter or CAR is cleavable. Examples of cleavable linkers include, include but are not limited to a peptide sequence recognized by proteases (in vitro or in vivo) of varying type, such as Tev, thrombin, factor Xa, plasmin (blood proteases), metalloproteases, cathepsins (e.g., GFLG, etc.), and proteases found in other corporeal compartments.

In some embodiments, the linker is a "cleavable linker" that facilitates the release of an Adapter functional domain or cytotoxic agent in a cell or at the cell surface. For example, an acid-labile linker (e.g., hydrazone), protease-sensitive (e.g., peptidase-sensitive) linker, photolabile linker, dimethyl linker or disulfide-containing linker (see, e.g., Chari, Can. Res. 52: 127-131 (1992); U.S. Pat. No. 5,208,020; and U.S. Appl. Pub. No. 20090110753; the contents of each of which is herein incorporated by reference in its entirety) can be used wherein it is desirable that the covalent attachment between an Adapter or a cytotoxic agent is intracellularly cleaved when the composition is internalized into the cell. The terms "intracellularly cleaved" and "intracellular cleavage" refer to a metabolic process or reaction inside a cell on an Adapter drug conjugate whereby the covalent attachment, i.e., linked via a linker between the Adapter and cytotoxic agent is broken, resulting in the free Adapter and/or cytotoxic agent dissociated inside the cell.

In additional embodiments, one or more of the linkers in the CAR is cleavable. Examples of cleavable linkers include, include but are not limited to a peptide sequence recognized by proteases (in vitro or in vivo) of varying type, such as Tev, thrombin, factor Xa, plasmin (blood proteases), metalloproteases, cathepsins (e.g., GFLG, etc.), and proteases found in other corporeal compartments.

In some embodiments, a short oligo- or polypeptide linker, from about 1 to 100 amino acids in length, is used to link together any of the domains of a CAR. Linkers can be composed of flexible residues like glycine and serine (or any other amino acid) so that the adjacent protein domains are free to move relative to one another. The amino acids sequence composition of the linker may be selected to minimize potential immunogenicity of the CAR. Longer linkers can be used when it is desirable to ensure that two adjacent domains do not sterically interfere with one another.

In some embodiments, preferably between 2 and 10 amino acids in length forms the linkage between the transmembrane domain and the cytoplasmic signaling domain of the CAR. In further embodiments, the linker is between 10 and 15 amino acids in length, or between 15 and 20, or between 20 and 30, or between 30 and 60, or between 60 and 100 amino acids in length (or any range in between those listed). In further embodiments, the linker is a glycine-serine doublet sequence. In some embodiments, the ESD corresponds to the human T cell surface glycoprotein CD8 alpha-chain ESD region (e.g., amino acid residues 138 to 182 CD8 alpha chain; Swiss-Prot Acc. No. P01732). In some embodiments, the ESD corresponds to the CD8 ESD region that has been further modified, through amino acid substitution, to improve expression function or immunogenicity. In further embodiments, the ESD corresponds to the CD28 ESD or sequences containing modifications of the CD28 ESD that confer improved expression function or immunogenicity.

Linker optimization can be evaluated using techniques described herein and/or otherwise known in the art. In some embodiments, linkers do not disrupt the ability of an Adapter or CAR to bind a target antigenic determinant and/or another Adapter or CAR functional domain to function appropriately (e.g., the ability of an effector functional domain in the Adapter to elicit an effector function or the ability of an FcRn binding domain in the Adapter to bind FcRn).

V. Adapters—Soluble Proteins

Provided herein are multi-domain soluble Adapter proteins. The Adapter comprises an antigenic determinant (AD) (e.g., as described in Section II and Section XI) and an antigenic determinant binding domain (ADBD) (e.g., as described in Section III and Section XI). The Adapter can further comprise additional ADs, additional ADBDs, and/or other additional domains.

In an Adapter provided herein, the AD can be N-terminal to ADBD. Alternatively, the ADBD can be N-terminal to the AD. In some embodiments, the AD and ADBD are directly fused. In some embodiments, the AD and the ADBD are fused via a linker (a protein linker or chemical linker) or another protein domain (e.g., a functional domain).

In some embodiments, the Adapter comprises a linker located between an ADBD and another functional domain of the Adapter. In some embodiments, the linker is located between two ADBDs of the Adapter. In some embodiments, the linker is located between the AD and an ADBD of the Adapter. Suitable linkers for coupling the two or more functional domains of the Adapter will be clear to persons skilled in the art and may generally be any linker used in the art to link peptides, proteins or other organic molecules. Exemplary linkers are provided in Section IV. In particular embodiments, the linker(s) is suitable for constructing proteins or polypeptides that are intended for pharmaceutical use.

In addition to the AD (or multiple ADs) and the ADBD (or multiple ADBDs), an Adapter provided herein can further comprise an additional domain or additional domains, e.g., a domain that confers an extended half-life.

In some embodiments, the Adapter, or the ADBD in the Adapter, is deimmunized.

The Adapters provided herein have uses that include but are not limited to diagnostic, analytic, and therapeutic applications. In particular embodiments, the Adapters are used in combination with chimeric antigen receptors (CARs) (e.g., as described in Section VI and Section XI) expressed on the surface of cells (e.g., as described in Section VII and Section XI), e.g., to kill a target cell.

Va. Antigenic Determinants (ADs)

An Adapter provided herein comprises at least one antigenic determinant (AD). In some embodiments, the Adapter comprises a single AD. In some embodiments, the Adapter comprises two or more ADs. Where an Adapter comprises two or more ADs, the ADs can be the same or different.

In an Adapter provided herein, the AD can be any AD or combination of ADs (e.g., as described in Section II and Section XI).

In some embodiments, the Adapter comprises the extracellular domain of BCMA (e.g., a polypeptide comprising the sequence of SEQ ID NO: 5. In some embodiments, the Adapter comprises 5-25, 5-50, 5-75, 5-100, 5-125, or 5-150 amino acid residues, more than 150 amino acid residues, or all of the amino acid residues of SEQ ID NO: 5.

In some embodiments, Adapter comprises the extracellular domain of CD123 (e.g., a polypeptide comprising the sequence of SEQ ID NO: 11. In some embodiments, the Adapter comprises 5-25, 5-50, 5-75, 5-100, 5-125, or 5-150 amino acid residues, more than 150 amino acid residues, or all of the amino acid residues of SEQ ID NO: 11.

In some embodiments, the Adapter comprises the extracellular domain of CD19 (e.g., a polypeptide comprising the sequence of SEQ ID NO: 2 or 3. In some embodiments, the Adapter comprises 5-25, 5-50, 5-75, 5-100, 5-125, or 5-150 amino acid residues, more than 150 amino acid residues, or all of the amino acid residues of SEQ ID NO: 2 or 3.

In some embodiments, the Adapter comprises the extracellular domain of CD20. In some embodiments, the Adapter comprises 5-25, 5-50, 5-75, 5-100, 5-125, or 5-150 amino acid residues, more than 150 amino acid residues, or all of the amino acid residues of SEQ ID NO: 6-9, or 10.

In some embodiments, the Adapter comprises the extracellular domain of CD22 (e.g., a polypeptide comprising the sequence of SEQ ID NO: 41). In some embodiments, the Adapter comprises 5-25, 5-50, 5-75, 5-100, 5-125, or 5-150 amino acid residues, more than 150 amino acid residues, or all of the amino acid residues of SEQ ID NO: 41.

In some embodiments, the Adapter comprises the extracellular domain of CD37 (e.g., a polypeptide comprising the sequence of SEQ ID NO: 12 or 13). In some embodiments, the Adapter comprises 5-25, 5-50, 5-75, 5-100, 5-125, or 5-150 amino acid residues, more than 150 amino acid residues, or all of the amino acid residues of SEQ ID NO: 12 or 13.

In some embodiments, the Adapter comprises the extracellular domain of CS1 (e.g., a polypeptide comprising the sequence of SEQ ID NO: 1138). In some embodiments, the Adapter comprises 5-25, 5-50, 5-75, 5-100, 5-125, or 5-150 amino acid residues, more than 150 amino acid residues, or all of the amino acid residues of SEQ ID NO: 1138.

In some embodiments, the Adapter comprises the extracellular domain of HER2 (e.g., a polypeptide comprising the sequence of SEQ ID NO: 42). In some embodiments, the Adapter comprises 5-25, 5-50, 5-75, 5-100, 5-125, or 5-150 amino acid residues, more than 150 amino acid residues, or all of the amino acid residues of SEQ ID NO: 42.

In some embodiments, the Adapter comprises the extracellular domain of CD45 (e.g., a polypeptide comprising the sequence of residues 29-766 of SEQ ID NO: 1106). In some embodiments, the Adapter comprises 5-25, 5-50, 5-75, 5-100, 5-125, or 5-150 amino acid residues, more than 150 amino acid residues, or all of the amino acid residues of residues 29-766 of SEQ ID NO: 1106.

In some embodiments, the Adapter comprises the extracellular domain of CD26, CD30, CD33, or CD38. In some embodiments, the Adapter comprises 5-25, 5-50, 5-75, 5-100, 5-125, or 5-150 amino acid residues, more than 150 amino acid residues, or all of the amino acid residues of the extracellular domain of CD26, CD30, CD33, or CD38.

In some embodiments, the AD is an epitope of AFP. In further embodiments, the AD comprises 5-25, 5-50, 5-75, 5-100, 5-125, or 5-150 amino acid residues, more than 150 amino acid residues, or all of the amino acid residues of SEQ ID NO: 15.

In some embodiments, the AD is an epitope of AFP p26. In further embodiments, the AD comprises 5-25, 5-50, 5-75, 5-100, 5-125, or 5-150 amino acid residues, more than 150 amino acid residues, or all of the amino acid residues of SEQ ID NO: 16. In further embodiments, the AD comprises 5-25, 5-50, 5-75, 5-100, 5-125, or 5-150 amino acid residues, more than 150 amino acid residues, or all of the amino acid residues of SEQ ID NO: 1117. In further embodiments, the AD comprises the amino acid residues of SEQ ID NO: 16, 1117, 1118, 1119, 1120, 1121, 1122, or 1123.

In some embodiments, Adapter comprises a p26 protein (e.g., having the sequence of SEQ ID NO: 16, 1117, 1118, 1119, 1120, 1121, 1122, or 1123). Such fusion proteins containing p26 sequences have been discovered herein to have surprisingly long serum half-life. In some embodiments, the Adapter has a plasma half-life in vivo of at least 1 hour, at least 2 hours, at least 4 hours, at least 8 hours, at least 16 hours, at least 32 hours, at least 64 hours, or more. In some embodiments, the Adapter has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours in a mouse. In some embodiments, the Adapter has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours, in a human.

In some embodiments, the disclosure provides a method for modifying the in vivo half-life (e.g., in a mouse or human) of an Adapter comprising a p26 protein (e.g., having the sequence of SEQ ID NO: 16, 1117, 1118, 1119, 1120, 1121, 1122, or 1123). In some embodiments, the Adapter comprises one or more target-binding DDpp. In some embodiments, the half-life of the Adapter is increased or decreased by substituting or deleting one or more amino acid residues normally found in the human p26 protein, or by inserting one or more amino acid residues not normally found in the human p26 protein. In another embodiment, the p26 sequence of the Adapter is modified through 1, 2, 3, 5, 5, 10, or 1-20, 1-10, 3-10, or 3-5, amino acid substitutions (conservative and/or nonconservative substitutions), deletions, and/or insertions so as to increase or decrease the in vivo half-life of the Adapter. In a particular embodiment, the amino acid residue corresponding to the glutamine (Gln, Q) at position 217 of p26 (SEQ ID NO: 16) is substituted with another amino acid residues. In a further embodiment, the substitution is Gln217Pro. In another embodiment, the p26 sequence of the Adapter is modified through deletion of 1-150, 1-100, 1-50, 1-25 or 1-10 amino acid residues so as to increase or decrease the in vivo half-life of the Adapter. In additional embodiments, the p26 sequence of the Adapter is modified through 1, 2, 3, 5, 5, 10 or 1-20, 1-10, 3-10, or 3-5, amino acid substitutions (conservative and/or nonconservative substitutions), deletions, and/or insertions so as to increase or decrease the interaction of the Adapter with FcRn.

In some embodiments, the AD (e.g., in an Adapter and/or on a target cell) is an AD that is present in a naturally occurring protein or other molecule. In some embodiments, the AD is an AD that is endogenous to humans.

In some embodiments, the AD is an epitope of a human intracellular protein. In further embodiments, the AD is an epitope of a human intracellular protein selected from: elastinTyk2, Jak1, Jak2, Jak3, LCK, ZAP-70, and GRB2. In further embodiments, the AD comprises 5-25, 5-50, 5-75, 5-100, 5-125, or 5-150 amino acid residues, more than 150 amino acid residues, or all of the amino acid residues of the intracellular protein.

In some embodiments, the target of interest specifically bound by the ADBD of an Adapter is itself an AD of another Adapter, having a different sequence.

Vb. Antigenic Determinant Binding Domains (ADBDs)

An Adapter provided herein comprises at least one antigenic determinant binding domain (ADBD). In some embodiments, the Adapter contains one ADBD. In some embodiments, the Adapter contains at least 2, 3, 4, or 5, or more than 5 ADBDs. In some embodiments, the Adapter contains 1-3, 1-4, 1-5, or more than 5 different ADBDs. In some embodiments, the Adapter contains at least 2, 3, 4, or 5, or more than 5 different ADBDs. Thus, an Adapter can comprise a monomeric ADBD (i.e., containing one antigenic determinant binding domain) or multimeric ADBDs (i.e., containing more than one antigenic determinant binding domains in tandem optionally operably connected by a linker). In some embodiments, the use of a multimeric Adapter provides enhanced (e.g., synergistic) target binding. In additional embodiments, the use of a multimeric Adapter allows for targeting of more than one target using a single Adapter construct (e.g., bi-, tri-specific, etc.).

The multimeric Adapter is homo-multimeric (i.e., containing more than one of the same ADBD optionally connected by linker(s)(e.g., homodimers, homotrimers, homotetramers etc.) or Adapter hetero-multimeric (i.e., containing two or more antigenic determinant binding domains in which there are at least two different antigenic determinant binding domains). The number of ADBDs included in any particular Adapter may vary, depending on the embodiment, and may be defined, at least in part, by the expression system in which the Adapter is produced. In several embodiments, however, the fusion proteins may comprise multimers of about 5 to about 10 ADBDs, about 10 to about 15 ADBDs, about 15 to about 20 ADBDs, about 20 to about 25 ADBDs, or about 25 to about 30 ADBDs (including numbers in between those listed as well as endpoints). Moreover, multiple domains of an Adapter can contain the same or different ADBD(s). In some embodiments, 2, 3, 4, 5, or more than 5 domains are in tandem.

In one embodiment, the Adapter comprises two or more ADBDs that are operably linked. In one embodiment, the Adapter comprises two ADBDs that bind to the same or different ADs on a target antigen. The linkage of two or more identical ADBDs that bind to the same target antigen results in a multivalent molecule that provides distinct advantages (e.g., increased binding avidity, target clustering and receptor activation) over compositions that only contain one ADBD for a target antigen. In another embodiment the Adapter comprises two ADBDs that bind to different antigens. In some embodiments the Adapter comprises two ADBDs that bind to different antigens on the same cell. In some embodiments the Adapter comprises two ADBDs that bind to different antigens on different cells. The linkage of two or more ADBDs results in a multivalent and multi-specific Adapter that has the potential to bind more than one target antigen, either independently or simultaneously. In some embodiments, the multivalent Adapter is able to bind the same target antigen simultaneously. In some embodiments, the multivalent Adapter is able to bind different target antigens simultaneously. In some embodiments, the Adapter comprises two or more operably linked ADBDs that are separated by an Antigenic Determinant. In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the Adapter comprises two or more operably linked ADBDs that are separated by a BCMA Antigenic Determinant. In further embodiments, the Adapter comprises two or more operably linked ADBDs that are separated by an AFP P26 Antigenic Determinant. In further embodiments, the Adapter comprises two or more operably linked ADBDs that are separated by a CD45 Antigenic Determinant. In further embodiments, the Adapter comprises two or more operably linked ADBDs that are separated by a CD26, CD30, CD33, or CD38 Antigenic Determinant.

An ADBD in the Adapter provided herein can bind to any AD (e.g., as described in Section II and Section XI). In some embodiments, the ADBD binds to BCMA (e.g., a polypeptide comprising the sequence of SEQ ID NO: 5). In some embodiments, the ADBD binds to CD123 (e.g., a polypeptide comprising the sequence of SEQ ID NO: 11). In some embodiments, the ADBD binds to CD22 (e.g., a polypeptide comprising the sequence of SEQ ID NO: 41). In some embodiments, the ADBD binds to CD19 (e.g., a polypeptide comprising the sequence of SEQ ID NO: 3). In some embodiments, the ADBD binds to CD20 (e.g., a polypeptide comprising the sequence of SEQ ID NO: 6-9 or 10). In some embodiments, the ADBD binds to CD37 (e.g., a polypeptide comprising the sequence of SEQ ID NO: 12 or 13). In some embodiments, the ADBD binds to CS1 (e.g., a polypeptide comprising the sequence of SEQ ID NO: 1138). In some embodiments, the ADBD binds to HER2 (e.g., a polypeptide comprising the sequence of SEQ ID NO: 42). In some embodiments, the ABDB binds to CD45. In some embodiments, the ABDB in the Adapter provided herein specifically binds to an AD of human CD26, CD30, CD33, or CD38. An Adapter can be "monospecific" or "multi-specific." An Adapter that is "multi-specific" (e.g., bispecific, trispecific or of greater multi-specificity) recognizes and binds to two or more different epitopes present on one or more different molecules.

In some embodiments, the Adapter comprises a domain (e.g., the extracellular domain) of BCMA (e.g., a polypeptide comprising the sequence of SEQ ID NO 4). In some embodiments, Adapter comprises a domain (e.g., the extracellular domain) of CD123 (e.g., a polypeptide comprising the sequence of SEQ ID NO: 11). In some embodiments, the Adapter comprises a domain (e.g., the extracellular domain) of CD22 (e.g., a polypeptide comprising the sequence of SEQ ID NO: 24). In some embodiments, the Adapter comprises a domain (e.g., the extracellular domain) of CD19 (e.g., a polypeptide comprising the sequence of SEQ ID NO: 3). In some embodiments, the Adapter comprises a domain (e.g., the extracellular domain) of CS1 (e.g., a polypeptide comprising the sequence of SEQ ID NO: 1138). In some embodiments, the Adapter comprises a domain (e.g., the extracellular domain) of HER2 (e.g., a polypeptide comprising the sequence of SEQ ID NO: 42). In some embodiments, the Adapter comprises a domain (e.g., the extracellular domain) of CD45. In some embodiments, the Adapter comprises a domain (e.g., the extracellular domain) of CD26, CD30, CD33, or CD38. In some embodiments, the Adapter comprises a fragment of a domain. In further embodiments, the Adapter comprises a fragment of a domain having an amino acid sequence selected from the group: SEQ ID NO: 4 or 5, SEQ ID NO: 11, SEQ ID NO: 24, and SEQ ID NO: 3. In some embodiments, the Adapter comprises a fragment of a domain that is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150, amino acids in length.

In some embodiments, the Adapter contains at least two ADBDs that bind and cross-link one or more target antigens bound by the ADBDs and/or complexes containing the target antigen(s). In some embodiments, the cross-linked antigen(s) is on the same cell. In some embodiments, the cross-linked antigen(s) is on different cells. In some embodiments, the Adapter comprises two or more operably linked ADBDs that are separated by an Antigenic Determinant (e.g., a domain described above). In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the Adapter comprises two or more operably linked ADBDs that are separated by a BCMA Antigenic Determinant. In further embodiments, the Adapter comprises two or more operably linked ADBDs that are separated by a CD45 Antigenic Determinant. In further embodiments, the Adapter comprises two or more operably linked ADBDs that are separated by a CD26, CD30, CD33, or CD38 Antigenic Determinant. In further embodiments, the Adapter comprises two or more operably linked ADBDs that are separated by an AFP P26 Antigenic Determinant.

In some embodiments, the Adapter contains at least two of the same ADBDs (i.e., is multivalent). In some embodiments, the multivalent Adapter is able to bind two or more of the same target antigens simultaneously. In some embodiments, the Adapter is multivalent and is able to bind the same target antigen simultaneously. In some embodiments, the multi-multivalent Adapter comprises two or more operably linked ADBDs that are separated by an Antigenic Determinant. In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the multivalent Adapter comprises two or more operably linked ADBDs that are separated by a BCMA Antigenic Determinant. In further embodiments, the multivalent Adapter comprises two or more operably linked ADBDs that are separated by a CD45 Antigenic Determinant. In further embodiments, the multivalent Adapter comprises two or more operably linked ADBDs that are separated by an AFP P26 Antigenic Determinant.

In some embodiments, the Adapter contains at least two ADBDs that bind to different antigens (i.e., is multispecific). In some embodiments, the multi-specific Adapter is able to bind the different target antigens simultaneously. In some embodiments, the Adapter is also multivalent and is able to bind the same target antigen simultaneously. In some embodiments, the multi-specific Adapter comprises two or more operably linked ADBDs that are separated by an Antigenic Determinant. In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the Adapter comprises two or more operably linked ADBDs that are separated by a BCMA Antigenic Determinant. In further embodiments, the Adapter comprises two or more operably linked ADBDs that are separated by a CD45 Antigenic Determinant. In further embodiments, the Adapter comprises two or more operably linked ADBDs that are separated by an AFP P26 Antigenic Determinant.

In one embodiment, a multi-specific Adapter contains at least two ADBDs that bind to at least two different epitopes on a single target of interest (i.e., is multiepitotic for the same target antigen). In additional embodiments, a multi-specific Adapter comprises at least one ADBD that specifically binds one epitope on a target of interest and at least one other ADBD that specifically binds to a different epitope on the same target antigen. In one embodiment, a multi-specific Adapter comprises at least one ADBD that specifically binds to an epitope on a first target antigen and at least one ADBD that specifically binds to an epitope on a second antigen. In some embodiments, the Adapter comprises at least one ADBD that specifically binds to an epitope on a first target antigen on a cell and at least one ADBD that specifically binds to an epitope on a second antigen on the same cell. In some embodiments, the Adapter comprises at least one ADBD that specifically binds to an epitope on a first target antigen on a cell and at least one ADBD that specifically binds to an epitope on a second antigen on a different cell.

In a further embodiment, the Adapter comprises 2 or more ADBDs that are operably linked with other heterologous proteins (or their subdomains) and in so doing, impart the multivalent, multi-specific, and/or functional properties (e.g., pharmacokinetics such as increased half-life) of the fusion partner to the Adapter fusion protein. Examples of fusion partners of an Adapter include but are not limited to, antibodies, antibody subdomains (e.g., scFv or Fc domains), serum albumin, serum albumin subdomains, cell surface receptors, an alpha chain of a T cell receptor (TCR), a beta chain of a T cell receptor, cell surface receptor subdomains, peptides, peptide tags (e.g., FLAG or myc). The number and location of ADBDs and their respective positions within the Adapter can vary. For example, ADBDs can be located at one or all termini of a fusion partner and/or interspersed within heterologous subunits within the Adapter fusion partner. In some embodiments the Adapter comprises 2 or more ADBDs that are separated by a heterologous protein (e.g., Antigenic Determinant). In some embodiments, the heterologous protein is at least 50, 75, 100, 150, 200, 250, 300, 350, 400, 450, or 500 amino acids in length. In some embodiments, the heterologous protein is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length.

In one embodiment, the Adapter is bispecific and contains ADBDs that specifically bind to two different target antigens. In further embodiments, the bispecific Adapter specifically binds to two different target antigens expressed on the surface of two different cell types. In further embodiments, the bispecific Adapter specifically binds to two different target antigens expressed on the surface of a tumor cell. In further embodiments, the bispecific Adapter specifically binds to two different target antigens expressed on the surface of a multiple myeloma cell (e.g., BCMA and CS1). In one embodiment, the bispecific Adapter binds to target antigens expressed on different cells. In a further embodiment, the bispecific Adapter binds to target antigens expressed on different cells of a tumor. In another embodiment, the bispecific Adapter binds to target antigens expressed on different cells within a tumor vasculature or tumor microenvironment. In one embodiment, the bispecific Adapter specifically binds to a cancer cell target and an immune effector cell target. In one embodiment the bispecific Adapter specifically binds a target expressed on a cancer cell (e.g. CD19) and a target expressed on the surface of a T lymphocyte (e.g., CD3 or CD45).). In some embodiments, the bispecific Adapter is able to bind the different target antigens simultaneously. In some embodiments, the bispecific Adapter comprises two or more operably linked ADBDs that are separated by an Antigenic Determinant. In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the Adapter comprises two or more operably linked ADBDs that are separated by a BCMA Antigenic Determinant. In further embodiments, the Adapter comprises two or more operably linked ADBDs that are separated by a CD45 Antigenic Determinant. In further embodiments, the Adapter comprises two or more operably linked ADBDs that are separated by an AFP P26 Antigenic Determinant.

In some embodiments where the Adapter comprises more than one ADBD, the ADBD can be any of the types of ADBD discussed herein (e.g., any ADBD described in Section III above and in and Section XI). For example, an ADBD can be an antibody, an antigen-binding fragment thereof, a ScFv, an alternative scaffold binding domain, a D domain, a T cell receptor, or an antigen-binding fragment thereof.

In some embodiments, where an Adapter comprises more than one ADBD, those ADBD can be the same types of antigen-binding molecules or can be different. For example, an Adapter can comprise two ADBD that are D domains. The two ADBD that are D domains can be the same or different. An Adapter can also comprise an ADBD that is a D domain and an ADBD that is a scFv. An Adapter can also comprise an ADBD that is a T cell receptor or antigen-binding fragment thereof and an ADBD that is a scFv. In some embodiments, the Adapter comprises two or more operably linked ADBDs that are separated by an Antigenic Determinant. In some embodiments, the Antigenic Determinant is at least 50, 75, 100, 150, 200, 250, 300, 350, 400, 450, or 500 amino acids in length. In some embodiments, the Antigenic Determinant is 5-500, 5-400, 10-300, 5-200, 50-100, 5-50, 10-500, 10-400, 10-300, 10-200, 10-100, 10-50, 50-500, 50-400, 50-300, 50-200, 50-100 50-75, 100-500, 100-400, 100-300, 100-200, or 100-150 amino acids in length. In further embodiments, the Adapter comprises two or more operably linked ADBDs that are separated by a BCMA Antigenic Determinant. In further embodiments, the Adapter comprises two or more operably linked ADBDs that are separated by a CD45 Antigenic Determinant. In further embodiments, the Adapter comprises two or more operably linked ADBDs that are separated by an AFP P26 Antigenic Determinant.

In some embodiments, the ADBD of the Adapter is deimmunized.

In some embodiments, the Adapter comprises an ABDB that binds to an antigen target containing an AD of interest, and has no discernable impact on the function of the target. Alternatively, in some embodiments, the Adapter comprises an ADBD that binds to an antigen target containing an AD of interest and completely or partially inhibits, antagonizes, agonizes, blocks, increases, stimulates, or interferes with the biological activity of the target. Binding can be identified as agonistic or antagonistic and determined using or routinely modifying assays, bioassays, and/or animal models known in the art for evaluating such activity.

An Adapter agonist refers to an Adapter that in some way increases or enhances the biological activity of the Adapter target or has biological activity comparable to a known agonist of the Adapter target. In another embodiment, the Adapter is an antagonist of the target it binds. An Adapter antagonist refers to an Adapter that completely or partially blocks or in some way interferes with the biological activity of the Adapter target or has biological activity comparable to a known antagonist or inhibitor of the Adapter target.

In one embodiment an Adapter specifically binds a target of interest that is a serum protein. In one embodiment, an Adapter specifically binds a serum protein selected from: serum albumin (e.g., human serum albumin (HSA)), thyroxin-binding protein, transferrin, fibrinogen, and an immunoglobulin (e.g., IgG, IgE and IgM). Without being bound by theory, the binding of an Adapter to a carrier protein is believed to confer upon the Adapter an improved pharmacodynamic profile that includes, but is not limited to, improved tumor targeting, tumor penetration, diffusion within the tumor, and enhanced therapeutic activity compared to the Adapter in which the carrier protein binding sequence is missing (see, e.g., WO 01/45746, the contents of which are herein incorporated by reference in its entirety).

In one embodiment the target of interest specifically bound by an Adapter is a disease-related antigen. The antigen can be an antigen characteristic of a cancer, and/or of a particular cell type (e.g., a hyperproliferative cell), and/or of a pathogen (e.g., a bacterial cell (e.g., tuberculosis, smallpox, and anthrax), a virus (e.g., HIV and H), a parasite (e.g., malaria and leishmaniosis), a fungal infection, a mold, a mycoplasm, a prion antigen, or an antigen associated with a disorder of the immune system.

In an additional embodiment, the target of interest bound by an Adapter (is a bacterial antigen, a viral antigen, a fungal antigen, a mycoplasm antigen, a prion antigen, or a parasite antigen (e.g., one infecting a mammal). In one embodiment, the target of an Adapter is human papillomavirus anthrax, hepatitis b, rabies, Nipah virus, west Nile virus, a meningitis virus, or CMV. In an additional embodiment, an Adapter specifically binds a pathogen.

Vc. Adapter Functional Domain(s)

In some embodiments, the Adapter comprises a first antigenic determinant (an AD), a domain that binds to a second antigenic determinant (an ADBD), and further comprises a functional domain that confers one or more additional desirable properties (e.g., improved manufacturing) and/or pharmacokinetic properties (e.g., improved half-life). The functional domain of the Adapter can be located between the AD and the ADBD. The Adapter can also be located N-terminal to both the AD and ADBD or C-terminal to both the AD and ADBD. In some embodiments, where the Adapter comprises two or more ADs, the functional domain of the Adapter can be located between two or more ADs, N-terminal to two or more ADs, or C-terminal to two or more ADs. In some embodiments, where the Adapter comprises two or more ADBDs, the functional domain of the Adapter can be located between two or more ADBDs, N-terminal to two or more ADBDs, or C-terminal to two or more ADBDs.

In some embodiments, the Adapter comprises a functional domain selected from: an Fc or variant Fc (e.g., a human Fc or variant Fc domain) or a fragment thereof, a serum protein (e.g., human serum albumin) or a fragment thereof; an FcRn binding domain; a serum protein binding domain; a cytokine, growth factor, hormone, or enzyme; an imaging agent; a labeling agent; and a peptide tag.

The functional domain(s) of the Adapter can be naturally derived or the result of recombinant engineering (e.g., phage display, xenomouse, or synthetic). In certain embodiments, the functional domain of the Adapter enhances half-life, increases or decreases antibody dependent cellular cytotoxicity (ADCC), and/or increases or decreases complement dependent cytotoxicity (CDC) activity.

In some embodiments, the Adapter comprises a functional domain selected from: an Fc or variant Fc (e.g., a human Fc or variant human Fc domain) or a fragment or derivative thereof, a serum protein (e.g., human serum albumin) or a fragment or derivative thereof (e.g., a serum protein binding domain); an FcRn binding domain; and a serum protein binding domain.

In one embodiment, an Adapter comprises a functional domain that comprises an antibody effector domain or derivative of an antibody effector domain that confers one or more effector functions to the Adapter, such as the ability to bind to one or more Fc receptors. In some embodiments, the functional domain comprises one or more CH2 and or CH3 domains of an antibody having effector function provided by the CH2 and CH3 domains. In some embodiments, the functional domain comprises one or more derivatives of CH2 and/or CH3 domains of an antibody having effector function provided by the CH2 and CH3 domains. Other sequences that can be included in the Adapter to provide an effector function and that are encompassed by the invention will be clear to those skilled in the art and can routinely be chosen and designed into an Adapter encompassed herein on the basis of the desired effector function(s).

In one embodiment, the Adapter comprises a functional domain that increases the antibody dependent cellular cytotoxicity (ADCC) conferred by the Adapter (see, e.g., Bruhns et al., Blood 113: 3716-3725 (2009); Shields et al., J. Biol. Chem. 276: 6591-6604 (2001); Lazar et al., PNAS 103: 4005-4010 (2006); Stavenhagen et al., Cancer Res. 67: 8882-8890 (2007); Horton et al., Cancer Res. 68: 8049-8057 (2008); Zalevsky et al., Blood 113: 3735-3743 (2009); Bruckheimer, Neoplasia 11: 509-517 (2009); WO2006/020114; Strohl, Curr. Op. Biotechnol. 20: 685-691 (2009); and WO2004/074455, each of which is herein incorporated by reference in its entirety). Examples of fragment engineering modifications of effector function conferring portions of an Fc contained in the functional domain of an Adapter that increases ADCC include one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; and IgG1-F243L, R292P, Y300L, V305I, P396L; wherein the numbering of the residues in the Fc region is that of the EU index of Kabat et al. (Kabat et al., Sequences of proteins of Immunological Interest, 1991 Fifth edition).

Accordingly, in some embodiments, the Adapter comprises a functional domain that comprises an antibody fragment that confers upon the Adapter a biological or biochemical characteristic of an immunoglobulin. In some embodiments, the antibody fragment confers a characteristic selected from: the ability to non-covalently dimerize, the ability to localize at the site of a tumor, and an increased serum half-life when compared to an Adapter without the antibody fragment. In certain embodiments, the Adapter is at least as stable as the corresponding antibody fragment without the Adapter. In certain embodiments, the Adapter is more stable than the corresponding antibody fragment without the Adapter. Adapter protein stability can be measured using established methods, including, for example, ELISA techniques. In some embodiments, the Adapter is stable in whole blood (in vivo or ex vivo) at 37° C. for at least about 10 hours, at least about 15 hours, at least about 20 hours, at least about 24 hours, at least about 25 hours, at least about 30 hours, at least about 35 hours, at least about 40 hours, at least about 45 hours, at least about 48 hours, at least about 50 hours, at least about 55 hours, at least about 60 hours, at least about 65 hours, at least about 70 hours, at least about 72 hours, at least about 75 hours, at least about 80 hours, at least about 85 hours, at least about 90 hours, at least about 95 hours, or at least about 100 hours (including any time between those listed). In one embodiment, the Adapter contains an immunoglobulin effector domain or half-life influencing domain that corresponds to an immunoglobulin domain or fragment in which at least a fraction of one or more of the constant region domains has been altered so as to provide desired biochemical characteristics such as reduced or increased effector functions, the ability to non-covalently dimerize, increased ability to localize at the site of a tumor, reduced serum half-life, or increased serum half-life when compared with an immunoglobulin fragment having the corresponding unaltered immunoglobulin sequence. These alterations of the constant region domains can be amino acid substitutions, insertions, or deletions.

In one embodiment, the Adapter comprises a functional domain that comprises an amino acid sequence of an immunoglobulin effector domain or a derivative of an immunoglobulin effector domain that confers antibody dependent cellular cytotoxicity (ADCC) to the Adapter. In additional embodiments, the Adapter comprises a sequence of an immunoglobulin effector domain that has been modified to increase ADCC (see, e.g., Bruhns, Blood 113: 3716-3725 (2009); Shields, J. Biol. Chem. 276: 6591-6604 (2001); Lazar, PNAS 103: 4005-4010 (2006); Stavenhagen, Cancer Res. 67: 8882-8890 (2007); Horton, Cancer Res. 68: 8049-8057 (2008); Zalevsky, Blood 113: 3735-3743 (2009); Bruckheimer, Neoplasia 11: 509-517 (2009); WO 06/020114; Strohl, Curr. Op. Biotechnol. 20: 685-691 (2009); and WO 04/074455, the contents of each of which is herein incorporated by reference in its entirety). Examples of immunoglobulin fragment engineering modifications contained in an amino acid sequence in the Adapter that increases ADCC include immunoglobulin effector domain sequences having one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; and IgG1-F243L, R292P, Y300L, V305I, P396L; wherein the numbering of the residues in the Fc region is that of the EU index of Kabat et al. (Kabat et al., Sequences of proteins of Immunological Interest, 1991 Fifth edition, herein incorporated by reference).

In additional embodiments, the Adapter comprises a functional domain that comprises the amino acid sequence of an immunoglobulin effector domain, or a derivative of an immunoglobulin effector domain, that confers antibody-dependent cell phagocytosis (ADCP) to the Adapter. In additional embodiments, the Adapter comprises a sequence of an immunoglobulin effector domain that has been modified to increase antibody-dependent cell phagocytosis (ADCP); (see, e.g., Shields et al., J. Biol. Chem. 276: 6591-6604 (2001); Lazar et al., PNAS 103: 4005-4010 (2006); Stavenhagen et al., Cancer Res. 67: 8882-8890 (2007); Richards et al., Mol. Cancer Ther. 7: 2517-2527 (2008); Horton et al., Cancer Res. 68: 8049-8057 (2008), Zalevsky et al., Blood 113: 3735-3743 (2009); Bruckheimer et al., Neoplasia 11: 509-517 (2009); WO 06/020114; Strohl, Curr. Op. Biotechnol. 20: 685-691 (2009); and WO 04/074455, the contents of each of which is herein incorporated by reference in its entirety). Examples of immunoglobulin fragment engineering modifications contained in an amino acid sequence in the Adapter that increases ADCP include immunoglobulin effector domain sequences having one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; IgG1-F243L, R292P, Y300L, V305I, P396L; and IgG1-G236A, S239D, I332E; wherein the numbering of the residues is that of the EU index of Kabat et al. (Kabat et al., Sequences of proteins of Immunological Interest, 1991 Fifth edition, herein incorporated by reference).

In additional embodiments, the Adapter comprises a functional domain that comprises an amino acid sequence of an immunoglobulin effector domain, or a derivative of an immunoglobulin effector domain, that confers complement-dependent cytotoxicity (CDC) to the Adapter. In additional embodiments, the Adapter comprises a sequence of an immunoglobulin effector domain that has been modified to increase complement-dependent cytotoxicity (CDC) (see, e.g., Idusogie et al., J. Immunol. 166: 2571-2575 (2001); Strohl, Curr. Op. Biotechnol. 20: 685-691 (2009); and Natsume et al., Cancer Res. 68: 3863-3872 (2008), the contents of each of which is herein incorporated by reference in its entirety). By way of example, Adapters can contain an antibody fragment or domain that contains one or more of the following modifications that increase CDC: IgG1-K326A, E333A; IgG1-K326W, E333S, IgG2-E333S; wherein the numbering of the residues is that of the EU index of Kabat et al. (Sequences of proteins of Immunological Interest, 1991 Fifth edition, herein incorporated by reference).

In additional embodiments, the Adapter comprises a functional domain that comprises an amino acid sequence of an immunoglobulin effector domain, or a derivative of an immunoglobulin effector domain, that confers the ability to bind FcgammaRIIb receptor to the Adapter. In additional embodiments, the Adapter comprises a sequence of an immunoglobulin effector domain that has been modified to increase inhibitory binding to FcgammaRIIb receptor (see, e.g., Chu et al., Mol. Immunol. 45: 3926-3933 (2008)). An example of an immunoglobulin fragment engineering modification contained in an amino acid sequence in the Adapter that increases binding to inhibitory FcgammaRIIb receptor is IgG1-S267E, L328F.

The half-life of an IgG is mediated by its pH-dependent binding to the neonatal receptor FcRn. In certain embodiments the Adapter contains a functional domain that comprises an amino acid sequence of an immunoglobulin effector domain, or a derivative of an immunoglobulin effector domain, that confers the ability to bind neonatal receptor FcRn to the Adapter. In certain embodiments the Adapter contains a functional domain that comprises a sequence of an immunoglobulin FcRn binding domain that has been modified to enhance binding to FcRn (see, e.g., Petkova et al., Int. Immunol. 18: 1759-1769 (2006); Dall'Acqua et al., J. Immunol. 169: 5171-5180 (2002); Oganesyan et al., Mol. Immunol. 46: 1750-1755 (2009); Dall'Acqua et al., J. Biol. Chem. 281: 23514-23524 (2006), Hinton et al., J. Immunol. 176: 346-356 (2006); Datta-Mannan et al., Drug Metab. Dispos. 35: 86-94 (2007); Datta-Mannan et al., J. Biol. Chem. 282: 1709-1717 (2007); WO 06/130834; Strohl, Curr. Op. Biotechnol. 20: 685-691 (2009); and Yeung et al., J. Immunol. 182: 7663-7671 (2009), the contents of each of which is herein incorporated by reference in its entirety).

In additional embodiments, the Adapter comprises a functional domain that comprises a sequence of an immunoglobulin effector domain that has been modified to have a selective affinity for FcRn at pH 6.0, but not pH 7.4. By way of example, the Adapter functional domain can contain an antibody fragment or domain that contains one or more of the following modifications that increase half-life: IgG1-M252Y, S254T, T256E; IgG1-T250Q, M428L; IgG1-H433K, N434Y; IgG1-N434A; and IgG1-T307A, E380A, N434A; wherein the numbering of the residues is that of the EU index of Kabat et al. (Kabat et al., Sequences of Proteins of Immunological Interest, 1991 Fifth edition, herein incorporated by reference).

According to another embodiment, the Adapter comprises a functional domain that comprises an amino acid sequence corresponding to a immunoglobulin effector domain that has been modified to contain at least one substitution in its sequence corresponding to the Fc region (e.g., Fc gamma) position selected from: 238, 239, 246, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 332, 333, 334, 335, 337, 338, 340, 360, 373, 376, 378, 382, 388, 389, 398, 414, 416, 419, 430, 434, 435, 437, 438, and 439, wherein the numbering of the residues in the Fc region is according to the EU numbering system; of Kabat et al. (Sequences of proteins of Immunological Interest, 1991 Fifth edition, herein incorporated by reference). In a specific embodiment, the Adapter contains a functional domain that comprises a sequence of an immunoglobulin effector domain derivative wherein at least one residue corresponding to position 434 is a residue selected from: A, W, Y, F and H. According to another embodiment, the Adapter comprises a sequence of an immunoglobulin effector fragment derivative having the following respective substitutions S298A/E333A/K334A. In an additional embodiment, the Adapter comprises an immunoglobulin effector domain derivative having a substitution corresponding to K322A. In another embodiment, the Adapter comprises a sequence of an immunoglobulin effector domain derivative having one or any combination of the following substitutions K246H, H268D, E283L, S324G, S239D and 1332E. According to yet another embodiment, the Adapter comprises a sequence of an immunoglobulin effector domain derivative having substitutions corresponding to D265A/N297A.

In certain embodiments, the Adapter comprises a functional domain that comprises a sequence of an immunoglobulin effector domain that has been glycoengineered or mutated to increase effector function using techniques known in the art. For example, the inactivation (through point mutations or other means) of a constant region domain sequence contained in the Adapter may reduce Fc receptor binding of the circulating Adapter thereby increasing tumor localization. In other cases it may be that constant region modifications consistent with certain embodiments of the instant invention moderate complement binding and thus reduce the serum half-life and nonspecific association of a conjugated cytotoxin. Yet other modifications of the constant region may be used to modify disulfide linkages or oligosaccharide moieties that allow for enhanced localization due to increased antigen specificity or antibody flexibility. The resulting physiological profile, bioavailability and other biochemical effects of the modifications, such as tumor localization, biodistribution and serum half-life, can easily be measured and quantified using well know immunological techniques without undue experimentation.

Adapter as Chemical Conjugates

Adapter that promote specific binding to targets of interest can be chemically conjugated with a variety of compound such as fluorescent dyes, radioisotopes, chromatography compositions (e.g., beads, resins, gels, etc.) and chemotherapeutic agents. Adapter conjugates have uses that include but are not limited to purification, diagnostic, analytic, manufacturing and therapeutic applications.

The inherent lack of cysteines in the Adapter sequence provides the opportunity for introduction of unique cysteines for purposes of site-specific conjugation.

In some embodiments, the Adapter contains at least one reactive residue. Reactive residues are useful, for example, as sites for the attachment of conjugates such as chemotherapeutic drugs. The reactive residue can be, for example, a cysteine, a lysine, or another reactive residue. Thus, a cysteine can be added to an Adapter at either the N- or C-terminus, or within the Adapter sequence. A cysteine can be substituted for another amino acid in the sequence of an Adapter. In addition, a lysine can be added to an Adapter at either end or within the Adapter sequence and/or a lysine can be substituted for another amino acid in the sequence of an Adapter. In one embodiment, a reactive residue (e.g., cysteine, lysine, etc.,) is located in a loop sequence of an ADBD (e.g., Z1 and Z2 of SEQ ID NOS: 22-25, or 26). In one embodiment, a reactive residue is located between components of an Adapter, e.g., in a linker located between an ADBD and other component of an Adapter fusion protein. The reactive residue (e.g., cysteine, lysine, etc.) can also be located within the sequence of an Adapter. In one embodiment, an Adapter comprises at least one, at least two, at least three reactive residues. In one embodiment, an Adapter comprises at least one, at least two, or at least three, cysteine residues.

Vd. Production of Adapters

The production of the Adapter, useful in practicing the provided methods, may be carried out using a variety of standard techniques for chemical synthesis, semi-synthetic methods, and recombinant DNA methodologies known in the art. Also provided is a method for producing the Adapter, individually or as part of multi-domain fusion protein, as soluble agents and cell associated proteins.

In several embodiments, the overall production scheme for the Adapter comprises obtaining a reference protein scaffold and identifying a plurality of residues within the scaffold for modification. Depending on the embodiment, the reference scaffold may comprise a protein structure with one or more alpha-helical regions, or other tertiary structure. Once identified, the plurality of residues can be modified, for example by substitution of an amino acid. In some embodiments substitution is conservative, while in other embodiments non-conservative substitutions are made. In some embodiments a natural amino acid (e.g., one of alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, or valine) is substituted into the reference scaffold at the targeted position for modification. In certain embodiments, the modifications do not include substituting in either a cysteine or a proline. After modifications have been made at all the identified positions desired in a particular embodiment, the resulting modified polypeptides (e.g., candidate Adapter) can be recombinantly expressed, for example in a plasmid, bacteria, phage, or other vector (e.g. to increase the number of each of the modified polypeptides). The modified polypeptides can then be purified and screened to identify those modified polypeptides that have specific binding to a particular target of interest. In several embodiments, certain modified polypeptides will show enhanced binding specificity for a target of interest vis-à-vis the reference scaffold, which in some embodiments may exhibit little or no binding to a given target of interest. In additional embodiments, depending on the target of interest the reference scaffold may show some interaction (e.g. nonspecific interaction) with a target of interest, while certain modified polypeptides will exhibit at least about two fold, at least about five fold, at least about 10 fold, at least about 20 fold, at least about 50 fold, or at least about 100 fold (or more) increased binding specificity for the target of interest. Optionally, the reference sequence and/or the modified polypeptides (e.g., Adapter) can be de-immunized. For example, residues or motifs that are potentially immunogenic can be identified and modified in order to reduce or eliminate potential immune responses to the Adapter. Additional details regarding various embodiments of the production, selection, and isolation of Adapter are provided in more detail below.

Ve. Recombinant Expression of Adapters

In some embodiments, the Adapter is "recombinantly produced," (i.e., produced using recombinant DNA technology). Exemplary recombinant methods available for synthesizing Adapter fusion proteins, include, but are not limited to polymerase chain reaction (PCR) based synthesis, concatemerization, seamless cloning, and recursive directional ligation (RDL)(see, e.g., Meyer et al., Biomacromolecules 3: 357-367 (2002), Kurihara et al., Biotechnol. Lett. 27: 665-670 (2005), Haider et al., Mol. Pharm. 2: 139-150 (2005); and McMillan et al., 32: 3643-3646 (1999), the contents of each of which is herein incorporated by reference in its entirety).

Nucleic acids comprising a polynucleotide sequence encoding the Adapter are also provided. Such polynucleotides optionally further comprise, one or more expression control elements. For example, the polynucleotide can comprise one or more promoters or transcriptional enhancers, ribosomal binding sites, transcription termination signals, and polyadenylation signals, as expression control elements. The polynucleotide can be inserted within any suitable vector, which can be contained within any suitable host cell for expression.

The expression of nucleic acids encoding the Adapter is typically achieved by operably linking a nucleic acid encoding the Adapter to a promoter in an expression vector. Typical expression vectors contain transcription and translation terminators, initiation sequences, and promoters useful for regulation of the expression of the desired nucleic acid sequence. Methods known in the art can be used to routinely construct expression vectors containing the nucleic acid sequence encoding an Adapter along with appropriate transcriptional/translational control signals. These methods include, but are not limited to in vitro recombinant DNA techniques, synthetic techniques and in vivo recombination/ genetic recombination. The expression of the polynucleotide can be performed in any suitable expression host known in the art including, but not limited to bacterial cells, yeast cells, insect cells, plant cells or mammalian cells. In one embodiment, a nucleic acid sequence encoding the Adapter is operably linked to a suitable promoter sequence such that the nucleic acid sequence is transcribed and/or translated into the Adapter in a host. Promoters useful for expression in E. coli, include but are not limited to, the T7 promoter.

In one embodiment, a vector comprising the Adapter encoding nucleic acid is introduced into a host cell (e.g., phagemid) for expression of the Adapter. The vector can remain episomal or become chromosomally integrated, as long as the insert encoding therapeutic agent can be transcribed. Vectors can be constructed by standard recombinant DNA technology. Vectors can be plasmids, phages, cosmids, phagemids, viruses, or any other types known in the art, which are used for replication and expression in prokaryotic or eukaryotic cells. It will be appreciated by one of skill in the art that a wide variety of components known in the art (such as expression control elements) can be included in such vectors, including a wide variety of transcription signals, such as promoters and other sequences that regulate the binding of RNA polymerase onto the promoter. Any promoter known or demonstrated to be effective in the cells in which the vector will be expressed can be used to initiate expression of the Adapter. Suitable promoters can be inducible (e.g., regulated) or constitutive. Non-limiting examples of suitable promoters include the SV40 early promoter region, the promoter contained in the 3' long terminal repeat of Rous sarcoma virus, the HSV-1 (herpes simplex virus-1) thymidine kinase promoter, the regulatory sequences of the metallothionein gene, etc., as well as the following animal transcriptional control regions, which exhibit tissue specificity and have been utilized in transgenic animals: elastase I gene control region which is active in pancreatic acinar cells; insulin gene control region which is active in pancreatic beta cells, mouse mammary tumor virus control region which is active in testicular, breast, lymphoid and mast cells, albumin gene control region which is active in liver, alpha-fetoprotein gene control region which is active in liver, alpha 1-antitrypsin gene control region which is active in the liver, beta-globin gene control region which is active in erythroid cells, myelin basic protein gene control region which is active in oligodendrocyte cells in the brain, myosin light chain-2 gene control region which is active in skeletal muscle, and gonadotropin releasing hormone gene control region which is active in the hypothalamus. In a particular embodiment, the promoter is an immunoglobulin gene control region which is active in lymphoid cells.

In one embodiment, one or several nucleic acids encoding the Adapter is expressed under the control of a constitutive promoter or, alternately, a regulated expression system. Suitable regulated expression systems include, but are not limited to, a tetracycline-regulated expression system, an ecdysone inducible expression system, a lac-switch expression system, a glucocorticoid-inducible expression system, a temperature-inducible promoter system, and a metallothionein metal-inducible expression system. If several different nucleic acids encoding the Adapter are contained within the host cell system, some of the nucleic acids may be expressed under the control of a constitutive promoter, while others may be expressed under the control of a regulated promoter. Expression levels may be determined by methods known in the art, including Western blot analysis and Northern blot analysis.

A variety of host-expression vector systems can be utilized to express a nucleic acid encoding the Adapter. Vectors containing the nucleic acids encoding the Adapter or portions or fragments thereof, include plasmid vectors, a single and double-stranded phage vectors, as well as single and double-stranded RNA or DNA viral vectors. Phage and viral vectors may also be introduced into host cells in the form of packaged or encapsulated virus using known techniques for infection and transduction. Moreover, viral vectors may be replication competent or alternatively, replication defective. Alternatively, cell-free translation systems may also be used to produce the protein using RNAs derived from the DNA expression constructs (see, e.g., WO86/05807 and WO89/01036; and U.S. Pat. No. 5,122,464, each incorporated in its entirety by reference herein).

Generally, any type of cells or cultured cell line can be used to express the Adapter provided herein. In some embodiments the background cell line used to generate an engineered host cells is a phage, a bacterial cell, a yeast cell or a mammalian cell. A variety of host-expression vector systems may be used to express the coding sequence of the Adapter. Mammalian cells can be used as host cell systems transfected with recombinant plasmid DNA or cosmid DNA expression vectors containing the coding sequence of the target of interest and the coding sequence of the Adapter.

The cells can be primary isolates from organisms (including human), cultures, or cell lines of transformed or transgenic nature. In some embodiments the host cell is a human cell. In some embodiments, the host cell is human T cell. In some embodiments, the host cell is derived from a human patient.

Useful host cells include but are not limited to microorganisms such as, bacteria (e.g., *E. coli* and *B. subtilis*) transformed with recombinant bacteriophage DNA, plasmid DNA or cosmid DNA expression vectors containing Adapter coding sequences; yeast (e.g., *Saccharomyces, Pichia*) transformed with recombinant yeast expression vectors containing Adapter coding sequences; insect cell systems infected with recombinant virus expression vectors (e.g., Baculovirus) containing Adapter coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing Adapter coding sequences. In particular embodiments, the mammalian cell systems are used to produce the Adapter. Mammalian cell systems typically utilize recombinant expression constructs containing promoters derived from the genome of mammalian cells (e.g., metallothionein promoter) or from mammalian viruses (e.g., the adenovirus late promoter; the vaccinia virus 7.5K promoter).

Prokaryotes useful as host cells in producing the Adapter, include gram negative or gram positive organisms such as, *E. coli* and *B. subtilis*. Expression vectors for use in prokaryotic host cells generally contain one or more phenotypic selectable marker genes (e.g., genes encoding proteins that confer antibiotic resistance or that supply an autotrophic requirement). Examples of useful prokaryotic host expression vectors include the pKK223-3 (Pharmacia, Uppsala, Sweden), pGEM1 (Promega, Wis., USA), pET (Novagen, Wis., USA) and pRSET (Invitrogen, Calif., USA) series of vectors (see, e.g., Studier, J. Mol. Biol. 219: 37 (1991) and Schoepfer, Gene 124: 83 (1993)). Exemplary promoter sequences frequently used in prokaryotic host cell expression vectors include T7, (Rosenberg et al., Gene 56: 125-135 (1987)), beta-lactamase (penicillinase), lactose promoter system (Chang et al., Nature 275: 615 (1978)); and Goeddel et al., Nature 281: 544 (1979)), tryptophan (trp) promoter system (Goeddel et al., Nucl. Acids Res. 8: 4057, (1980)), and tac promoter (Sambrook et al., 1990, Molecular Cloning, A Laboratory Manual, 2d Ed., Cold Spring Harbor Laboratory, Cold Spring Harbor, N.Y.).

In one embodiment, a eukaryotic host cell systems is used, including yeast cells transformed with recombinant yeast expression vectors containing the coding sequence of an Adapter, such as, the expression systems taught in U.S. Appl. No. 60/344,169 and WO03/056914 (methods for producing humanlike glycoprotein in a non-human eukaryotic host cell)(the contents of each of which are incorporated by reference in their entirety). Exemplary yeast that can be used to produce compositions of the invention, such as, DBD, include yeast from the genus *Saccharomyces, Pichia*, Actinomycetes and *Kluyveromyces*. Yeast vectors typically contain an origin of replication sequence from a 2mu yeast plasmid, an autonomously replicating sequence (ARS), a promoter region, sequences for polyadenylation, sequences for transcription termination, and a selectable marker gene. Examples of promoter sequences in yeast expression constructs include, promoters from metallothionein, 3-phosphoglycerate kinase (Hitzeman, J. Biol. Chem. 255: 2073 (1980)) and other glycolytic enzymes, such as, enolase, glyceraldehyde-3-phosphate dehydrogenase, hexokinase, pyruvate decarboxylase, phosphofructokinase, glucose-6-phosphate isomerase, 3-phospho glycerate mutase, pyruvate kinase, triosephosphate isomerase, phosphoglucose isomerase, and glucokinase. Additional suitable vectors and promoters for use in yeast expression as well as yeast transformation protocols are known in the art. See, e.g., Fleer, Gene 107: 285-195 (1991) and Hinnen, PNAS 75: 1929 (1978).

Insect and plant host cell culture systems are also useful for producing the compositions of the invention. Such host cell systems include for example, insect cell systems infected with recombinant virus expression vectors (e.g., baculovirus) containing the coding sequence of a DBD; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing the coding sequence of a DBD, including, but not limited to, the expression systems taught in U.S. Pat. No. 6,815,184; U.S. Publ. Nos. 60/365,769, and 60/368,047; and WO2004/057002, WO2004/024927, and WO2003/078614, the contents of each of which is herein incorporated by reference in its entirety.

In an additional embodiment the host cell systems may be used, including animal cell systems infected with recombinant virus expression vectors (e.g., adenoviruses, retroviruses, adeno-associated viruses, herpes viruses, lentiviruses) including cell lines engineered to contain multiple copies of the DNA encoding an Adapter either stably amplified (CHO/dhfr) or unstably amplified in double-minute chromosomes (e.g., murine cell lines). In one embodiment, the vector comprising the polynucleotide(s) encoding the Adapter is polycistronic. Exemplary mammalian cells useful for producing these compositions include 293 cells (e.g., 293T and 293F), CHO cells, BHK cells, NSO cells, SP2/0 cells, YO myeloma cells, P3X63 mouse myeloma cells, PER cells, PER.C6 (Crucell, Netherlands) cells VERY, Hela cells, COS cells, MDCK cells, 3T3 cells, W138 cells, BT483 cells, Hs578T cells, HTB2 cells, BT20 cells, T47D cells, CRL7O30 cells, HsS78Bst cells, hybridoma cells, and other mammalian cells. Additional exemplary mammalian host cells that are useful in practicing the invention include but are not limited, to T cells. Some examples of expression systems and selection methods are described in the following references and references cited therein: Borth et al., Biotechnol. Bioen. 71(4): 266-73 (2000), in Werner et al., Arzneimittelforschung/Drug Res. 48(8): 870-80 (1998), Andersen et al., Curr. Op. Biotechnol. 13: 117-123 (2002), Chadd et al., Curr. Op. Biotechnol. 12: 188-194 (2001), and Giddings, Curr. Op. Biotechnol. 12: 450-454 (2001). Additional examples of expression systems and selection methods are described in Logan et al., PNAS 81: 355-359 (1984), Birtner et al. Methods Enzymol. 153: 51-544 (1987)). Transcriptional and translational control sequences for mammalian host cell expression vectors are frequently derived from viral genomes. Commonly used promoter sequences and enhancer sequences in mammalian expression vectors include, sequences derived from Polyoma virus, Adenovirus 2, Simian Virus 40 (SV40), and human cytomegalovirus (CMV). Exemplary commercially available expression vectors for use in mammalian host cells include pCEP4 (Invitrogen) and pcDNA3 (Invitrogen).

Physical methods for introducing a nucleic acid into a host cell (e.g., a mammalian host cell) include calcium phosphate precipitation, lipofection, particle bombardment, microinjection, electroporation, and other methods known in the art. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York).

Biological methods for introducing a polynucleotide of interest into a host cell include the use of DNA and RNA vectors. Viral vectors, and especially retroviral vectors, have become the most widely used method for inserting genes into mammalian (e.g., human) cells. Other viral vectors can be derived from lentivirus, poxviruses, herpes simplex virus I, adenoviruses and adeno-associated viruses, and other viral vectors known in the art. See, for example, U.S. Pat. Nos. 5,350,674 and 5,585,362, the contents of each of which is herein incorporated by reference in its entirety.

Methods for introducing a DNA and RNA polynucleotides of interest into a host cell include electroporation of cells, in which an electrical field is applied to cells in order to increase the permeability of the cell membrane, allowing chemicals, drugs, or polynucleotides to be introduced into the cell. Adapter encoding DNA or RNA constructs may be introduced into mammalian or prokaryotic cells using electroporation.

In a preferred embodiment, electroporation of cells results in the expression of a CAR on the surface of T cells, NK cells, NKT cells. Such expression may be transient or stable over the life of the cell. Electroporation may be accomplished with methods known in the art including MaxCyte GT® and STX® Transfection Systems (MaxCyte, Gaithersburg, Md., USA).

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid can be associated with a lipid. The nucleic acid associated with a lipid can be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they can be present in a bilayer structure, as micelles, or with a "collapsed" structure. They can also simply be interspersed in a solution, possibly forming aggregates that are not uniform in size or shape. Lipids are fatty substances which can be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristoyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristoyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform may be used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., Glycobiology 5: 505-510 (1991)). However, compositions that have different structures in solution than the normal vesicular structure are also encompassed. For example, the lipids can assume a micellar structure or merely exist as non-uniform aggregates of lipid molecules. Also contemplated are lipofectamine-nucleic acid complexes.

Regardless of the method used to introduce exogenous nucleic acids into a host cell, or the presence of the recombinant nucleic acid sequence in the host cell can routinely be confirmed through a variety of assays known in the art. Such assays include, for example, "molecular biological" assays known in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Reporter genes are used for identifying potentially transfected cells and for evaluating the functionality of regulatory sequences. In general, a reporter gene is a gene that is not present in or expressed by the recipient organism, tissue, or cell and that encodes a polypeptide whose expression is manifested by some easily detectable property, e.g., enzymatic activity. Expression of the reporter gene is assayed at a suitable time after the DNA has been introduced into the recipient cells. A non-limiting list of suitable reporter genes can include genes encoding luciferase, beta-galactosidase, chloramphenicol acetyl transferase, secreted alkaline phosphatase, or the green fluorescent protein gene (e.g., Ui-Tei et al., FEBS Lett. 479: 79-82 (2000)). Suitable expression systems are known in the art and can be prepared using known techniques or obtained commercially. In general, the construct with the minimal 5' flanking region showing the highest level of expression of reporter gene is identified as the promoter. Such promoter regions can routinely be linked to a reporter gene and used to evaluate agents for the ability to modulate promoter-driven transcription.

A number of selection systems can be used in mammalian host-vector expression systems, including, but not limited to, the herpes simplex virus thymidine kinase, hypoxanthine-guanine phosphoribosyltransferase and adenine phosphoribosyltransferase (Lowy et al., Cell 22: 817 (1980)) genes, which can be employed in tk$^-$, hgprt$^-$ or aprt$^-$ cells, respectively. Additionally, antimetabolite resistance can be used as the basis of selection for e.g., dhfr, gpt, neo, hygro, trpB, hisD, ODC (ornithine decarboxylase), and the glutamine synthase system.

Vf. Adapter Purification

Once an Adapter has been produced by recombinant expression, it can be purified by any method known in the art for purification of a recombinant protein, for example, by chromatography (e.g., ion exchange, affinity, and sizing column chromatography), centrifugation, differential solubility, or by any other standard technique for the purification of proteins. In additional embodiments, the Adapter is optionally fused to a heterologous polypeptide sequences described herein or otherwise known in the art to facilitate purification. More particularly, it is envisioned that ligands (e.g., antibodies and other affinity matrices) for Adapter affinity columns for affinity purification and that optionally, the Adapter or other components of the Adapter fusion composition that are bound by these ligands are removed from the composition prior to final preparation of the Adapter using techniques known in the art.

Vg. Chemical Synthesis of Adapters

In addition to recombinant methods, Adapter production may also be carried out using organic chemical synthesis of the desired polypeptide using a variety of liquid and solid phase chemical processes known in the art. Various automatic synthesizers are commercially available and can be used in accordance with known protocols. See, for example, Tam et al., J. Am. Chem. Soc. 105: 6442 (1983); Merrifield, Science 232: 341-347 (1986); Barany and Merrifield, The Peptides, Gross and Meienhofer, eds, Academic Press, New York, 1-284; Barany et al., Int. J. Pep. Protein Res. 30: 705-739 (1987); Kelley et al. in Genetic Engineering Principles and Methods, Setlow, J. K., ed. Plenum Press, N Y. 1990, vol. 12, pp. 1-19; Stewart et al., Solid-Phase Peptide Synthesis, W.H. Freeman Co., San Francisco, 1989. One advantage of these methodologies is that they allow for the incorporation of non-natural amino acid residues into the sequence of the Adapter.

The Adapters that are used in the methods of the present invention may be modified during or after synthesis or translation, e.g., by glycosylation, acetylation, benzylation, phosphorylation, amidation, pegylation, formylation, derivatization by known protecting/blocking groups, proteolytic cleavage, linkage to an antibody molecule, hydroxylation, iodination, methylation, myristoylation, oxidation, pegylation, proteolytic processing, phosphorylation, prenylation, racemization, selenoylation, sulfation, ubiquitination, etc. (see, e.g., Creighton, Proteins: Structures and Molecular Properties, 2d Ed. (W.H. Freeman and Co., N.Y., 1992); Postranslational Covalent Modification of Proteins, Johnson, ed. (Academic Press, New York, 1983), pp. 1-12; Seifter, Meth. Enzymol. 182: 626-646 (1990); Rattan, Ann. NY Acad. Sci. 663: 48-62 (1992).) In specific embodiments, the peptides are acetylated at the N-terminus and/or amidated at the C-terminus.

Any of numerous chemical modifications may be carried out by known techniques, including, but not limited to acetylation, formylation, etc. Additionally, the derivative may contain one or more non-classical amino acids.

VI. Chimeric Antigen Receptors

As provided herein, chimeric antigen receptors (CARs) are multi-domain proteins that comprise an extracellular domain comprising an ADBD, a transmembrane domain, and an intracellular signaling domain Such CARs can be expressed on the surface of cells (e.g., as described in Section VII and Section XI) and used in combination with Adapters (e.g., as described in Section V and Section XI), for example, to kill a target cell. In several embodiments, the ADBD is made up of, at least in part, a target-binding polypeptide as disclosed herein. In several embodiments, the intracellular signaling domain is selected from the group: a human CD3 zeta domain, 41BB domain, a CD28 domain and any combination thereof. Depending on the embodiment, the costimulatory signaling region comprises the intracellular domain of a costimulatory molecule selected from the group: CD27, CD28, 41BB, OX40, CD30, CD40, PD1, lymphocyte function-associated antigen-1 (LFA1), CD2, CD7, LIGHT, NKG2C, B7H3, a ligand that specifically binds with CD83, and any combination thereof. In several embodiments, the CAR comprises a fusion protein that includes an additional target-binding polypeptide. Also provided for are isolated nucleic acid sequences encoding CARs that include the target-binding polypeptides as part (or all) of the targeting region.

In some embodiments, the ADBD of a CAR comprises at least one alternative scaffold binding domain (e.g., a D domain or affibody) designed to impart binding specificity to a membrane bound CAR. A receptor comprising an alternative scaffold binding domain may be expressed by any cell type.

In one embodiment, the CAR is composed of the following elements: an extracellular domain, a transmembrane domain and a cytoplasmic domain wherein the cytoplasmic domain comprises the signaling domain. In another embodiment the CAR is composed of an extracellular domain and a transmembrane domain. In a further embodiment the CAR is comprised of an extracellular domain composed of one or more ADBDs with the same or different specificities. In one embodiment, the intracellular domain (e.g., the cytoplasmic domain) of the CAR comprises the intracellular domain of CD3 zeta chain. In another embodiment the intracellular signaling domain of the CAR is comprised of part of the intracellular domain of CD3 zeta chain. In a further embodiment, the intracellular domain of the CAR comprises the intracellular domain of CD3 zeta chain and a costimulatory signaling region. The costimulatory signaling region refers to a portion of the CAR comprising all or part of the intracellular domain of a costimulatory molecule. Costimulatory molecules and portions of these molecules that are able to confer costimulatory properties to a CAR are known in the art and can routinely be incorporated into the CAR. In addition, truncations or mutation to these intracellular signaling and costimulatory domains may be incorporated to further enhance or reduce receptor signaling. In preferred embodiments, a T cell is genetically modified to stably express a CAR. In such embodiments the cytoplasmic domain of the CAR can be designed to comprise the CD28 and/or 41BB signaling domain by itself or be combined with any other desired cytoplasmic domain(s) useful in the context of the invention. In one embodiment, the cytoplasmic domain of the CAR can be designed to further comprise the signaling domain of CD3-zeta. In one embodiment, the CAR comprises an extracellular domain, an extracellular protein linker with a transmembrane domain that passes through the cellular membrane (such as found in T cells or NK cells), and a cytoplasmic domain, optionally comprising multiple signaling modules. In several embodiments, the CAR may also comprise an epitope tag. In several embodiments, the cytoplasmic domain of the CAR can include but is not limited to CD3-zeta, 41BB and CD28 signaling modules and combinations thereof.

VIa. CAR Extracellular Antigenic Determinant Binding Domain

The CARs provided herein comprise one or more antigenic determinant binding domains (ADBDs). The ADBD of the CAR can be any ADBD described herein (e.g., as described in Section III and Section XI). An exemplary ADBD comprises a polypeptide, e.g., an antibody molecule (which includes an antibody, and antigen binding fragments thereof, e.g., an immunoglobulin, single domain antibody (sdAb), and a scFv), or a non-antibody scaffold (e.g., a D domain, or affibody).

Depending on the desired antigen(s) to be targeted, the extracellular domain of the CAR can be engineered to include one or more antigenic determinant binding domains (ADBDs) that specifically bind the desired antigen target(s). For example, in one embodiment, the CAR is engineered to target CD19 and a CD19-binding ADBD is incorporated into the extracellular domain of the CAR. Alternatively, an extracellular domain of a CAR may include more than one ADBD, thereby imparting multi-specificity or multi-valency to the CAR.

The choice of ADBDs in the extracellular domain of the CAR depends upon the identity of the cell or cells to be targeted. For example, the extracellular domain of the CAR may be engineered to specifically bind to cell surface proteins, such as a receptor, on the same cell or another cell. In other embodiments, the extracellular domain of the CAR is engineered to specifically bind to a soluble molecule, such as an immunoglobulin. In other embodiments the targets of interest bound by the CAR include those associated with viral, bacterial and parasitic infections, diseases and disorders of the immune system (e.g., autoimmune disease).

In other embodiments, the extracellular domain of the CAR contains one or more ADBDs that bind a ligand that acts as a cell surface marker on target cells associated with a cancer. In some embodiments, ADBD(s) target and bind a tumor or cancer antigen (e.g., a TAA, TSA, CAA, CSA or other tumor antigen described herein or otherwise known in the art). Accordingly, provided herein are methods for creating CAR, their use in creating chimeric cells such as, human T cells and natural killer cells, and the use of these chimeric T and NK cells in adoptive immunotherapy.

The choice of an ADBD can depend upon the type and number of ligands or receptors that define the surface of a target cell. For example, the ADBD may be chosen to recognize a ligand or receptor that acts as a cell surface marker on target cells associated with a particular disease state. Examples of cell surface markers that may act as ligands or receptors include a cell surface marker associated with a particular disease state, e.g., cell surface makers for viral diseases, bacterial diseases parasitic infections, autoimmune diseases and disorders associated with unwanted cell proliferation, e.g., a cancer, such as, a cancer described herein.

The target of interest specifically bound by the ADBD of the CAR can be any molecule for which it is desirable for a CAR or an Adapter to bind, e.g., any of the ADs described in Section IIa and Section XI.

In some embodiments, the ADBD binds to a target listed in Table 4. In further embodiments, the ADBD comprises 1, 2, 3, 4, 5, 1-5, 1-10, or more than 10, D domain sequences listed in Table 3 (e.g., SEQ ID NO: 44-1078, or 1079). In some embodiments, the ADBD comprises 1, 2, 3, 4, 5, 1-5, 1-10, or more than 10, different D domain sequences listed in Table 3.

In some embodiments, the ADBD binds to BCMA (e.g., a polypeptide comprising the sequence of SEQ ID NO: 5). In some embodiments, the ADBD comprises a DD sequence selected from the group: SEQ ID NO: 44-338, and 339.

In some embodiments, the ADBD binds to CS1 (e.g., a polypeptide comprising the sequence of SEQ ID NO: 1138). In some embodiments, the ADBD comprises a DD sequence selected from the group: SEQ ID NO: 780-794, and 795

In some embodiments, the ADBD binds to HER2 (e.g., a polypeptide comprising the sequence of SEQ ID NO: 42). In some embodiments, the ADBD comprises a DD sequence selected from the group: SEQ ID NO: 800-839, and 840

In some embodiments, the ADBD binds to CD123 (e.g., a polypeptide comprising the sequence of SEQ ID NO: 11). In some embodiments, the ADBD comprises a DD sequence selected from the group: SEQ ID NO: 340-772 and 773.

In some embodiments, the ADBD binds to AFP (e.g., a polypeptide comprising the sequence of SEQ ID NO: 14 or 15). In some embodiments, the ADBD binds to AFP p26 (e.g., a polypeptide comprising the sequence of SEQ ID NO: 16, 1117, 1118, 1119, 1120, 1121, 1122, or 1123). In some embodiments, the ADBD comprises a DD sequence selected from the group: SEQ ID NO: 841-983 and 984.

In some embodiments, the ADBD binds to CD137 (e.g., a polypeptide comprising the sequence of SEQ ID NO: 1081). In further embodiments, the ADBD comprises a DD sequence selected from the group: SEQ ID NO: 985-990 and 991.

In some embodiments, the ADBD binds to CD47. In further embodiments, the ADBD comprises a DD sequence selected from the group: SEQ ID NO: 992-995 and 996.

In some embodiments, the ADBD binds to CTLA4. In further embodiments, the ADBD comprises a DD sequence of SEQ ID NO: 997.

In some embodiments, the ADBD binds to DR5. In further embodiments, the ADBD comprises a DD sequence selected from the group: SEQ ID NO: 998-1006, 1070-1072, and 1073.

In some embodiments, the ADBD binds to KIR. In further embodiments, the ADBD comprises a DD sequence selected from the group: SEQ ID NO: 1007, 1008, and 1009.

In some embodiments, the ADBD binds to PDL1. In further embodiments, the ADBD comprises a DD sequence selected from the group: SEQ ID NO: 1010-1016, 1074-1078, and 1079.

In some embodiments, the ADBD binds to TIM3. In further embodiments, the ADBD comprises the DD sequence of SEQ ID NO: 1017.

In some embodiments, the ADBD binds to PD1. In further embodiments, the ADBD comprises a DD sequence selected from the group: SEQ ID NO: 1018, 1019, and 1020.

In some embodiments, the ADBD binds to CD137. In further embodiments, the ADBD comprises a DD sequence selected from the group: SEQ ID NO: 985-990 and 991.

In some embodiments, the ADBD binds to CD19 (e.g., a polypeptide comprising the sequence of SEQ ID NO: 3). In some embodiments, the ADBD binds to CD20 (e.g., a polypeptide comprising the sequence of SEQ ID NO: 6-9 or 10). In further embodiments, the ADBD comprises a DD sequence selected from the group: SEQ ID NO: 1030-1058, and 1059.

In some embodiments, the ADBD binds to CD22 (e.g., a polypeptide comprising the sequence of SEQ ID NO: 41). In further embodiments, the ADBD comprises a DD sequence selected from the group: SEQ ID NO: 1060-1068, and 1069.

In some embodiments, the ADBD binds an intracellular protein. In further embodiments, the ADBD comprises a DD sequence that binds an intracellular protein selected from the group: elastin, Tyk2, Jak1, Jak2, Jak3, LCK, ZAP-70, and GRB2.

In some embodiments, the ADBD binds to the extracellular domain (ECD) of human CD45 (e.g., residues 29-766 of SEQ ID NO: 1106).

In some embodiments, the ADBD binds to CD26 (e.g., residues 29-766 of SEQ ID NO: 1113).

In some embodiments, the ADBD binds to CD30 (e.g., residues 19-379 of SEQ ID NO: 1114).

In some embodiments, the ADBD binds to CD33 (e.g., residues 18-259 of SEQ ID NO: 1115).

In some embodiments, the ADBD binds to CD38 (e.g., residues 43-300 of SEQ ID NO: 1116).

In some embodiments, the ADBD binds a tumor antigen or cancer antigen that comprises one or more antigenic cancer epitopes immunologically recognized by tumor infiltrating lymphocytes (TIL) derived from a cancer or tumor of a mammal.

In some embodiments, the ADBD binds an AD expressed on the surface of an immune effectore cell.

In some embodiments, the CAR binds to an AD (e.g., in an Adapter and/or on a target cell) that is present in a naturally occurring protein or other molecule. In some embodiments, the CAR binds to an AD that is endogenous to humans.

In some embodiments, a CAR provided herein comprises an ADBD (e.g., an antibody fragment or ASBD) that binds to a MHC presented-peptide. Normally, peptides derived from endogenous proteins fill the pocket of Major histocompatibility complex (MHC) class I molecules, and are recognized by T cell receptors (TCRs) on CD8+T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigenic determinants in the context of human leukocyte antigen (HLA)-A1 or HLA-A2 have been described (see, e.g., Sastry et al., J. Virol. 85(5): 1935-1942 (2011); Sergeeva et al., Blood 117(16): 4262-4272 (2011); Verma et al., J. Immunol. 184(4): 2156-2165 (2010); Willemsen et al., Gene Ther. 8(21): 1601-1608 (2001); Dao et al., Sci. Transl. Med. 5(176): 176ra33 (2013); Tassev et al., Cancer Gene Ther. 19(2): 84-100 (2012)). For example, TCR-like antibody can be identified from screening a library, such as a human scFv phage displayed library. Accordingly, in some embodiments, the disclosure provides a CAR that comprises an ADBD that binds to a MHC presented peptide of a molecule selected from any tumor antigen described above that is expressed intracellularly, e.g., p53, BCR-Ab1, Ras, K-ras, NY-ESO-1, and c-met.

In some embodiments, the CAR comprises an ADBD that is an antibody or an antigen-binding fragment thereof. In some embodiments, the CAR comprises an ADBD that is a scFv. In some embodiments, the CAR comprises an ADBD that is an alternative scaffold binding domain. In some embodiments, the CAR comprises an ADBD that is a D domain. In some embodiments, the CAR comprises a T cell receptor, or an antigen-binding fragment thereof.

Also provided herein are CAR wherein the CAR comprises a plurality of ADBDs. In some embodiments, the CAR comprises a plurality of the same ADBD. In some embodiments, the CAR comprises a plurality of different ADBDs. In some embodiments, the CAR comprises a plurality of ADBDs that bind the same antigenic determinant. In some embodiments, the CAR comprises a plurality of ADBDs, wherein the binding domains bind to different ADs. In some embodiments, the CAR comprises a plurality of ADBDs, wherein the binding domains bind to different ADs on the same cell. In some embodiments, the CAR comprises a plurality of ADBDs, wherein the binding domains bind to different ADs on different cells.

In some embodiments, a CAR comprises a plurality of, e.g., 2, 3, 4, 5, or more than 5, ADBDs (e.g., D domains, affibodies, or scFvs), wherein each ADBD(s) are able to bind to a target antigen. In one embodiment, two or more of the ADBDs of a CAR can bind to different ADs. In an additional embodiment, two or more of the ADBDs of the CAR can bind to the same antigen, e.g., the same or different epitopes on the same antigen. In one embodiment, a plurality of ADBDs of the CAR are linked to each other, e.g., the C-terminus of a first ADBD is linked to the N-terminus of a second ADBD. In an embodiment, the C-terminus of a first ADBD is linked to the N-terminus of a second ADBD by a covalent bond, e.g., a peptide bond.

In some embodiments, a linker or hinge region is contained between one or more of the ADBDs, e.g., a linker or hinge region is located between the C-terminus of a first ADBD and the N-terminus of a second ADBD. By way of example, an antigen binding member comprising two ADBDs (e.g., $ADBD_1$ and $ADBD_2$) can be arranged in the following configuration: $[ADBD_1]$-[linker/hinge]-$[ADBD_2]$. Additional ADBDs can be added in a similar manner, optionally with linker or hinge regions located between the C-terminus of an ADBD and the N-terminus of the next ADBD. Linkers or hinge regions suitable for use in linking a plurality of antigen binding members are flexible, non-cleavable, and allow near-free motion of each ADBD independent from the other ADBDs to encourage binding with multiple target ADs simultaneously. Any flexible linker or hinge region known in the art can be used. Examples of linkers include peptide linkers comprising glycine and serine residues, e.g., (GGGGS)n, where n is a positive integer equal to or greater than 1, e.g., n=1, 2, 3, 4, 5, 6, 7, 8, 9, or 10 (SEQ ID NO: 43).

VIb. Extracellular Spacer Domain

In some embodiments, the CARs comprise an extracellular spacer domain. As used herein, the term "extracellular spacer domain" or "ESD" refers to a polypeptide sequence of a CAR disposed between the ADBD and the transmembrane domain. In an embodiment the extracellular spacer domain allows sufficient distance from the outer surface of the cell and the ADBD as well as flexibility to minimize steric hindrance between the cell and the ADBD.

In particular embodiments, the extracellular spacer domain is sufficiently short or flexible that it does not interfere with engagement of the cell that includes the CAR with a cell bearing an AD, e.g., a target cell. In an embodiment, the extracellular spacer domain is from 2 to 20, 5 to 15, 7 to 12, or 8 to 10 amino acids in length. In some embodiments, the ESD domain includes at least 50, 20, or 10 residues. In some embodiments the ESD is 10 to 300, 10 to 250, or 10 to 200 residues in length.

In some embodiments the distance from which the ESD extends from the cell is sufficiently short that the hinge does not hinder engagement of the CAR ADBD with the surface of a target cell. In some embodiment the ESD extends less than 20, 15, or 10 nanometers from the surface of the cytotoxic cell. Thus, suitability for an ESD can be influenced by both linear length, the number of amino acid residues and flexibility of the ESD. By way of example, an IgG4 ESD can be as long as 200 amino acids in length, but the distance it extends from the surface of the cytotoxic cell is smaller due to Ig-domain folding. A CD8 alpha ESD, which is ~43 amino acids at ~8 nm in length. In contrast, the IgG4 C2 & C3 ESD is ~200 amino acids in length, but has a distance from the cytotoxic cell surface that is comparable to that of the CD8 alpha ESD. While not wishing to be bound by theory, the similarity in extension is influenced by flexibility.

In some embodiments, the extracellular spacer domains include but are not limited to Fc fragments of antibodies or fragments or derivatives thereof, hinge regions of antibodies or fragments or derivatives thereof, CH2 regions of antibodies, CH3 regions of antibodies, artificial spacer sequences or combinations thereof. Additional examples of extracellular spacer domains include but are not limited to CD8a hinge, and artificial spacers made of polypeptides which may be as small as, for example, Gly3 or CH1 and CH3 domains of IgGs (such as human IgG4). In some embodiments, the extracellular spacer domain is any one or more of (i) a hinge, CH2 and CH3 regions of IgG4, (ii) a hinge region of IgG4, (iii) a hinge and CH2 of IgG4, (iv) a hinge region of CD8a, (v) a hinge, CH2 and CH3 regions of IgG1, (vi) a hinge region of IgG1 or (vi) a hinge and CH2 region of IgG1. Other extracellular spacer domains will be apparent to those of skill in the art and may be used in connection with alternate embodiments provided herein.

In some embodiments, the ESD is a naturally occurring sequence. In some embodiments, the ESD of the CAR corresponds to an ESD from a human protein, a fragment thereof, or a short oligo- or polypeptide linker. In some embodiments, the CAR ESD corresponds to a human Ig (immunoglobulin) ESD (hinge), or fragment thereof. In one embodiment, the ESD comprises (e.g., consists of) the amino acid sequence of the IgG4 ESD. In one embodiment, for example, the hinge comprises (e.g., consists of) the amino acid sequence of the IgD hinge. In some embodiments, the hinge can be a human CD8 hinge, or fragment thereof. In one embodiment, for example, the hinge comprises (e.g., consists of) the amino acid sequence of the CD8 hinge.

In some embodiments, the ESD is an artificial sequence. In one embodiment, the ESD is a short oligopeptide linker comprising a glycine-serine doublet.

In some embodiments, the CARs do not contain an extracellular spacer domain.

VIc. Transmembrane Domain

The term "transmembrane domain" (TMD) as used herein refers to the region of a cell surface expressed protein, such as a CAR, which spans the plasma membrane. In some embodiments, the TMD links an extracellular sequence, e.g., an extracellular ADBD, and an intracellular sequence, such as an intracellular signaling domain. In some embodiments, the transmembrane domain of the CAR is the transmembrane region of a transmembrane protein (for example Type I transmembrane proteins), an artificial hydrophobic sequence or a combination thereof. Other transmembrane domains will be apparent to those of skill in the art and may be used in connection with alternate embodiments of the invention.

The CAR can be designed to contain a transmembrane domain that is fused to the extracellular domain of the receptor. As described above, the fusion of the extracellular and transmembrane domains can be accomplished with or without a linker. In one embodiment, the transmembrane domain that is naturally associated with one of the domains in the CAR is used. In a specific embodiment, the transmembrane domain in the CAR is the CD8 transmembrane domain. In some instances, the transmembrane domain of the CAR comprises the CD8 hinge domain. In some embodiments, the transmembrane domain is selected or modified by amino acid substitution to promote or inhibit association with other surface membrane proteins.

The transmembrane domain can be derived either from a natural or from a synthetic source. Where the source is natural, the domain can be derived from any membrane-bound or transmembrane protein. Transmembrane regions of particular use for the purposes herein may be derived from (i.e., comprise at least the transmembrane region(s) of) a member selected from the group: the alpha, beta or zeta chain of the T cell receptor; CD28, CD3 epsilon, CD45, CD4, CD5, CD8, CD9, CD16, CD22, CD33, CD37, CD64, CD80, CD86, CD134, CD137, and CD154. In some embodiments, the transmembrane domain is derived from the transmembrane region(s) of a NKR. In further embodiments, the transmembrane domain is derived from the transmembrane region of a molecule selected from the group consisting of, KIRDS2, OX40, TNFR2, LFA1 (CD11a, CD18), ICOS, 41BB, GITR, LTBR, BAFFR, HVEM, NKp80 (KLRF1), IL2R beta, IL2R gamma, IL7R α, ITGA1, ITGA4, ITGA6, ITGAD, ITGAE, ITGAL, ITGAM, ITGB7, VLA1, VLA6, IA4, ITGAX, CD11c, ITGB1 CD27, CD29, ITGB2, CD2, CD11a, CD11b, CD11d, CD18, CD19, CD40, CD49a, CD49d, CD49f, CD84, CD96, CD100, CD103, CD160, CD162, CD226, CD229, CEACAM1, CRTAM, PSGL1, SLAM (SLAMF1), SLAMF4, SLAMF6 (NTB-A, Ly108), SLAMF7, SLAMF8, SELPLG, and PAG/Cbp. Alternatively, the transmembrane domain can be synthetic, and preferably predominantly comprises hydrophobic residues such as leucine and valine. In further embodiments, the transmembrane domain comprises the triplet of FWV (phenylalanine, tryptophan and valine) at each end of the transmembrane domain.

Exemplary NKR domains, e.g., transmembrane, hinge or stem, or intracellular (e.g., cytoplasmic) domains (identified by the NKR from which the domain is derived) Killer immunoglobulin KIR2DL1 receptors (KIRs) include KIR2DL2/L3, KIR2DL4, KIR2DL5A, KIR2DL5B, KIR2DS1, KIR2DS2, KIR2DS3, KIR2DS4, KIR2DS5, KIR3DL1/S1, KIR3DL2, KIR3DL3, KIR2DP1, KIR2DP1, NCRs, NKp30, NKp44, NKp46, SLAM; Receptors SLAM, CD48, CD229, 2B4, CD84, NTB-A, CRACC, BLAME, CD2F-10, SLAMF6, SLAMF7; Fc-binding Receptors CD16, FcgRIII, CD64, Ly49; Receptors Ly49, Lectin-related NK Ly49A cell receptor, Ly49C; other NK receptors NKG2D, CD160 (TM containing splice variant(s)) DNAM1, CRTAM, CD27, PSGL1, CD96, CD100, NKp80, CEACAM1, and CD244.

VId. Intracellular Signaling Domain

Described herein are intracellular signaling domains that can be used in a chimeric antigen receptor (CAR) according to the present invention.

"Intracellular signaling domain" (ISD) or "cytoplasmic domain" as used herein refer to the portion of the CAR which transduces the effector function signal and directs the cell to perform its specialized function (e.g., cytolytic activity and helper activity, including cytokine secretion).

The cytoplasmic domain (i.e., intracellular signaling domain) of a CAR is responsible for activation of at least one of the normal effector functions of an immune cell engineered to express a CAR. The term "effector function" refers to a specialized function of a cell. The effector function of a T cell, for example, includes cytolytic activity and helper activity including the secretion of cytokines. Thus the term "intracellular signaling domain" refers to the portion of a CAR protein which transduces the effector function signal and directs the cell to perform a specialized function. While typically the entire intracellular signaling domain corresponding to a naturally occurring receptor can be employed, in many cases it is not necessary to use the entire chain. To the extent that a truncated portion of the intracellular signaling domain is used, such truncated portion can be used in place of the intact chain as long as it transduces the effector function signal. The term intracellular signaling domain is thus meant to include any truncated portion of the intracellular signaling domain sufficient to transduce the effector function signal. In one embodiment, an intracellular signaling domain in the CAR includes the cytoplasmic sequences of the T cell receptor (TCR) and also the sequence of co-receptors that act in concert to initiate signal transduction following antigen receptor engagement, or any derivative or variant of these sequences that has functional capability. Examples of domains that transduce an effector function signal include but are not limited to the chain of the ζ cell receptor complex or any of its homologues (e.g., η chain, FcsRly and β chains, MB 1 (Igα) chain, B29 (Ig) chain, etc.), human CD3 zeta chain, CD3 polypeptides (Δ, δ and ε), syk family tyrosine kinases (Syk, ZAP 70, etc.), src family tyrosine kinases (Lck, Fyn, Lyn, etc.) and other molecules involved in T cell transduction, such as CD2, CD5 and CD28.

In some embodiments, the intracellular signaling domain of the CAR produces an intracellular signal when an extracellular domain (e.g., an ADBD) to which it is fused, binds a cognate AD. The Intracellular signaling domains of the CAR can include primary intracellular signaling domains and costimulatory signaling domains. In one embodiment, the CAR is constructed for expression in an immune cell (e.g., a T or NK cell), such that the expressed CAR comprises a domain such as a primary intracellular signaling domain and/or costimulatory signaling domain, that is derived from a polypeptide typically associated with the immune cell. For example, in some embodiments, the CAR is for expression in a T cell and comprises a 41BB domain and a CD3 zeta domain. In another embodiment, the CAR molecule is constructed for expression in an immune cell such that the expressed CAR comprises a domain that is derived from a polypeptide that is not typically associated with the immune cell. For example, in some embodiments the CAR for expression in a T cell comprises a KIR domain derived from a NK cell. In an alternative embodiment, the CAR for expression in an NK cell comprises a 41BB domain and a CD3 zeta domain derived from a T cell (See e.g. WO2013/033626, incorporated herein by reference).

The intracellular signaling domain of the CAR comprises sufficient primary stimulatory molecule sequence to produce an intracellular signal, e.g., when an ADBD to which it is fused binds a cognate AD. In particular embodiments, the intracellular signal of the CAR mediates a T cell response selected from the group: proliferation, cytokine secretion, killing, activation, and differentiation.

In one embodiment, the intracellular signaling region of the CAR comprises a domain that contains an immunoreceptor tyrosine-based activation motif (ITAM). In a further embodiment, the CAR intracellular signaling region comprises ITAM containing domain from a molecule selected from: TCR zeta (CD3 zeta), FcR gamma (FCER1G), Fc gamma RIIa, FcR beta (FCER1B), CD3 gamma, CD3 delta, CD3 epsilon, CD3 gamma, CD5, CD22, CD79a, CD79b, DAP10, DAP12, CD32 (Fc gamma RIIa), CD79a, and CD79b. In a specific embodiment, the intracellular signaling domain of the CAR comprises a CD3 zeta signaling domain. In another specific embodiment, the intracellular signaling domain of the CAR comprises a DAP12 signaling domain. In some embodiments, the ITAM containing signaling domain has at least 70, 75, 80, 85, 90, 95, 98, or 99% sequence identity with, or differs by no more than 30, 25, 20, 15, 10, 5, 4, 3, 2, or 1 amino acid residues from the corresponding residues of a naturally occurring ITAM containing domain.

Examples of ITAM containing primary cytoplasmic signaling sequences that are of particular use in the invention include those derived from TCR zeta, FcR gamma, FcR beta, CD3 gamma, CD3 delta, CD3 epsilon, CD22, CD79a, CD79b, and CD66d. It is particularly preferred that a cytoplasmic signaling molecule in the CAR comprises a cytoplasmic signaling sequence derived from CD3 zeta.

In a preferred embodiment, the cytoplasmic domain of the CAR comprises the CD3-zeta signaling domain by itself or combined with any other desired cytoplasmic domain(s) useful in the context of the CAR. For example, the cytoplasmic domain of the CAR can comprise a CD3 zeta chain portion and a costimulatory signaling region. The costimulatory signaling region refers to a portion of the CAR comprising the intracellular domain of a costimulatory molecule. A costimulatory molecule is a cell surface molecule other than an antigen receptor or their ligands that is required for an efficient response of lymphocytes to an antigen. Examples of such molecules include CD27, CD28, 41BB (CD 137), OX40, CD30, CD40, PD1, ICOS, lymphocyte function-associated antigen-1 (LFA1), CD2, CD7, LIGHT, NKG2C, B7H3, TIM1, and LAG3.

"Co-stimulatory domain" (CSD) as used herein refers to the portion of the CAR which enhances the proliferation, survival and/or development of memory cells. The CAR may comprise one or more co-stimulatory domains. Each co-stimulatory domain comprises the costimulatory domain of any one or more of, for example, a member of the TNFR superfamily, selected from CD28, CD137 (41BB), CD134 (OX40), Dap10, CD27, CD2, CD5, ICAM1, LFA1(CD11a/CD18), Lck, TNFRI, TNFRII, Fas, CD30, and CD40 or a combination thereof. Other co-stimulatory domains (e.g., from other proteins) will be apparent to those of skill in the art and may be used in connection with alternate embodiments of the invention.

In some embodiments, the intracellular domain of the CAR comprises an ITAM containing domain and a costimulatory signaling domain that comprises a functional fragment or analog of a costimulatory molecule that is sufficient to produce an intracellular signal when an extracellular ADBD to which it is fused, binds cognate ligand. In some embodiments, the CAR comprises a costimulatory signaling domain corresponding to that found in a molecule selected from: CD137 (41BB), OX40, LIGHT, TNFR2, TRANCE/RANKL, GITR, BAFFR, HVEM, B7H3, CDS, IL2R beta, IL2R gamma, IL7R alpha, ITGA4, ITGA6, ITGAD, ITGAE, ITGAL, ITGAM, ITGAX, ITGB1, ITGB2, ITGB7, VLA1, VLA6, C49f, IA4, LFA1, CD2, CD4, CD7, CD8 alpha, CD8 beta, CD11A, CD11B, CD11C, CD11D, CD18, CD19, CD27, CD28, CD29, CD30, CD40, CD49A, CD49D, CD69, CD84, CD96, CD100, CD103, CD150, CD160, CD162, CD226, CD229, CD278, ICAM1, CEACAM1, CRTAM, PSGL1, SLAMF1, SLAMF4, SLAMF6, SLAMF7, SLAMF8, LTBR, LAT, GADS, PAG/Cbp, SLP76, NKG2C, NKp30, NKp44, NKp46 and NKp80.

In some embodiments, the CAR comprises a costimulatory domain corresponding to that found in a molecule selected from the group consisting 41BB, CD28, CD27, ICOS, and OX40.

In some embodiments, the CAR comprises a plurality of costimulatory domains. In particular embodiments, the CAR comprises the following costimulatory signaling domains, from the extracellular to intracellular direction: 41BB-CD27, CD27-41BB, 41BB-CD28, CD28-41BB, OX40-CD28, CD28-OX40, CD28-41BB; or 41BB-CD28.

In some embodiments the costimulatory signaling domain of the CAR has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of a naturally occurring costimulatory domain.

Polypeptide linkers may be positioned between adjacent elements of the CAR. For example linkers may be positioned between adjacent ADBDs or between an ADBD and the transmembrane domain or between the transmembrane domain and the cytoplasmic domain or between adjacent cytoplasmic domains. The cytoplasmic signaling sequences within the cytoplasmic signaling portion of the CAR may be linked to each other in a random or specified order. Optionally, a short linker, preferably between 2 and 10 amino acids in length may form the linkage. A glycine-serine doublet provides a particularly suitable linker.

VIe. Expression of CARs

CARs are intentionally cell associated and used in the context of the cell in which they are expressed. One particular embodiment relates to a strategy of adoptive cell transfer of T cells which have been transduced to express a CAR. Preferably, the cell can be genetically modified to stably express a CAR on its surface, conferring novel target specificity that is MHC independent.

A variety of viral-derived vectors can be used in applications in which viruses are used for transfection and integration into a mammalian cell genome. Viruses, which are useful as vectors include, but are not limited to, retroviruses, adenoviruses, adeno-associated viruses, herpes viruses, and lentiviruses. Lentiviral vectors are particularly suitable to achieving long-term gene transfer (e.g., adoptive T cell immune therapy) since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. In general, a suitable vector contains an origin of replication functional in at least one organism, a promoter sequence, convenient restriction endonuclease sites, and one or more selectable markers, (e.g., Intl. Appl. Publ. Nos. WO 01/96584 and WO 01/29058; and U.S. Pat. No. 6,326,193). Several vector promoter sequences are available for expression of the transgenes. One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is EF-1a. However, other constitutive promoter sequences can also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Inducible promoters include, but are not limited to a metallothionein promoter, a glucocorticoid promoter, a progesterone promoter, and a tetracycline promoter.

In order to assess the expression of a CAR polypeptide or portions thereof, the expression vector introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and are otherwise known in the art.

Prior to expansion and genetic modification of the T cells of the invention, a source of T cells is obtained from a subject. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain embodiments provided herein, any number of T cell lines available in the art, may be used.

A full discussion of T cell isolation, culturing, activation and expansion methods may be found in WO 2012079000, the contents of which is herein incorporated by reference in its entirety.

Additionally provided is a host cell comprising nucleic acids encoding a CAR described herein. Further provided is a composition comprising a nucleic acid sequence encoding the CAR.

VII. Chimeric Antigen Receptor Cells

The disclosure provides compositions and methods to regulate the specificity and activity of cells modified to express one or more different CAR(s).

In some embodiments, cells are engineered to express one or more of the CARs described herein. Such CAR-containing cells, referred to as "CAR cells" have uses in monotherapy and in combination therapies that include other therapeutic agents, such as the Adapters described herein, for example, to kill a target cell.

In some embodiments, a CAR cell comprises a nucleic acid sequence encoding a CAR, wherein the CAR comprises an extracellular domain made up of, at least in part, an ADBD that binds a target of interest, a transmembrane domain, and a signaling domain. In several embodiments, the encoded CAR polypeptide binds specifically to a tumor antigen (and thus functions to deliver the cell expressing the CAR to the tumor). In several embodiments, the tumor antigen bound by the CAR is associated with a hematologic malignancy. In additional embodiments, tumor antigen bound by the CAR is associated with a solid tumor. In further embodiments the CAR is engineered to bind both solid and hematologic tumors. Depending on the embodiment, the cell expressing the CAR can be an immune effector cell (e.g., a T cell or a natural killer (NK) cell) or another cell type. In several embodiments, the cell (whether T cell, NK cell or other cell type) exhibits an anti-tumor immunity when the antigen-binding domain of the CAR binds to its targeted tumor antigen(s).

In some embodiments, prior to expansion and genetic modification or other modification, a source of cells (e.g., T cells or natural killer cells), can routinely be obtained from a subject using techniques known in the art. The term "subject" is intended to include living organisms in which an immune response can be elicited (e.g., mammals). T cells can be obtained from sources, including but not limited to peripheral blood mononuclear cells, bone marrow, lymph node tissue, cord blood, thymus tissue, tissue from a site of infection, ascites, pleural effusion, spleen tissue, and tumors.

In some embodiments, the CAR cell is capable of killing a target cell, e.g., when the ADBD of the CAR interacts with an AD, which can be present on the surface of a target cell and/or in an Adapter. In some embodiments, the CAR cell is capable of degranulating, e.g., when the ADBD of the CAR interacts with an AD, which can be present on the surface of a target cell and/or in an Adapter. In some embodiments, the CAR cell is capable of secreting a cytokine or cytokines, e.g., when the ADBD of the CAR interacts with an AD, which can be present on the surface of a target cell and/or in an Adapter.

In some embodiments, the CAR-containing cell is an immune cell. In some embodiments, the CAR-containing cell is an immune effector cell. In further embodiments, the CAR-containing immune cell is a cytotoxic cell. In further embodiments, the cytotoxic cell is selected from a T cell, NK cell, or a cultured NK cell (e.g., a NK92 cell).

In certain embodiments, an immune effector cell comprises a cell surface receptor for an immunoglobulin or other peptide binding molecule, such as a receptor for an immunoglobulin constant region and including the class of receptors commonly referred to as "Fc receptors" ("FcR"s). A number of FcRs have been structurally and/or functionally characterized and are known in the art, including FcR having specific abilities to interact with a restricted subset of immunoglobulin heavy chain isotypes, or that interact with Fc domains with varying affinities, and/or which may be expressed on restricted subsets of immune effector cells under certain conditions (e.g., Kijimoto-Ochichai et al., Cell Mol. Life. Sci. 59: 648 (2002); Davis et al., Curr. Top. Microbiol. Immunol. 266: 85 (2002); Pawankar, Curr. Opin. Allerg. Clin. Immunol. 1: 3 (2001); Radaev et al., Mol. Immunol. 38: 1073 (2002); Wurzburg et al., Mol. Immunol. 38: 1063 (2002); Sulica et al., Int. Rev. Immunol. 20: 371 (2001); Underhill et al., Ann. Rev. Immunol. 20: 825 (2002); Coggeshall, Curr. Dir. Autoimm 5: 1 (2002); Mimura et al., Adv. Exp. Med. Biol. 495: 49 (2001); Baumann et al., Adv. Exp. Med. Biol. 495: 219 (2001); Santoso et al., Ital. Heart J. 2: 811 (2001); Novak et al., Curr. Opin. Immunol. 13: 721 (2001); Fossati et al., Eur. J. Clin. Invest. 31: 821 (2001)), the contents of each of which is herein incorporated by reference in its entirety.

Cells that are capable of mediating ADCC are examples of immune effector cells. Other immune effector cells include Natural Killer cells, tumor-infiltrating T lymphocytes (TILs), cytotoxic T lymphocytes, and granulocytic cells such as cells that comprise allergic response mechanisms Immune effector cells thus include, but are not limited to, cells of hematopoietic origin including cells at various stages of differentiation within myeloid and lymphoid lineages and which may (but need not) express one or more types of functional cell surface FcR, such as T lymphocytes, B lymphocytes, NK cells, monocytes, macrophages, dendritic cells, neutrophils, basophils, eosinophils, mast cells, platelets, erythrocytes, and precursors, progenitors (e.g., hematopoietic stem cells), as well as quiescent, activated, and mature forms of such cells. Other immune effector cells may include cells of non-hematopoietic origin that are capable of mediating immune functions, for example, endothelial cells, keratinocytes, fibroblasts, osteoclasts, epithelial cells, and other cells Immune effector cells can also include cells that mediate cytotoxic or cytostatic events, or endocytic, phagocytic, or pinocytotic events, or that effect induction of apoptosis, or that effect microbial immunity or neutralization of microbial infection, or cells that mediate allergic, inflammatory, hypersensitivity and/or autoimmune reactions.

In some embodiments, the CAR-containing cell is a T cell. In some embodiments, the CAR-containing cell is a NK cell. In additional embodiments, the CAR-containing cell is a B cell. Other immune cells, and/or combinations of different immune cell types can optionally be used. In some embodiments, combinations of cell types (e.g., NK cells and T cells) are advantageous because they act synergistically to treat a disease or condition (e.g., a hyperproliferative disease such as cancer). When combinations are used, the various cell types can target the same, different, or overlapping tumor antigenic determinants.

In some embodiments, the CAR-containing immune cell is a T cell, and the binding of the ADBD of the CAR to a cognate ligand (i.e., target of interest) stimulates the T cell to initiate intracellular signaling. In further embodiments, binding of the ADBD of the CAR to a cognate ligand stimulates the T cell to produce cytokines and degranulate, leading to the cytotoxic effects on the cell expressing the target of interest on its surface (e.g., a cancer cell). In additional embodiments, the CAR-containing T cell proliferates in response to binding the target of interest. In some embodiments, the activity of the CAR-containing T cell does not result in the T cells exhibiting a phenotype associated with T cell exhaustion. In some embodiments where the CAR cell is a T cell, the transmembrane domain of the CAR comprises 41BB or CD28, and the cytoplasmic domain comprises a T cell receptor alpha, beta, or zeta chain.

In some embodiments, the CAR-containing immune cell is a NK cell, the transmembrane domain comprises CD28, and the cytoplasmic domain comprises a zeta chain of a T cell receptor.

In some embodiments, the CAR-containing immune cell has been engineered to bind to a target of interest expressed by a cancer cell. In further embodiments the CAR-containing cell binds a tumor antigen selected from the group: CD137, PDL1, CD123, CTLA4, CD47, KIR, DR5, TIM3, PD1, EGFR, TCR, CD19, CD20, CD22, ROR1, mesothelin, CD33, 1L3Ra, cMet, PSMA, Glycolipid F77, EGFRvIII, GD2, NY-ESO-1, and MAGE A3. In further embodiments the CAR-containing cell binds 2, 3, 4, 5 or more of the above tumor antigens.

In some embodiments, the CAR of the CAR cell binds two or more targets of interest. In further embodiments, the CAR further comprises a second polypeptide comprising the amino acid of SEQ ID NO: 17-26, or 27, the polypeptide being able to specifically bind a second target of interest expressed by a cancer cell, and wherein the second polypeptide's specific binding the second target of interest is greater than binding of a polypeptide according to SEQ ID NO: 1 to the second target of interest.

In some embodiments, the CAR cell is engineered to express an Adapter disclosed herein (e.g., as described in Section V and Section XI).

In additional embodiments, the CAR cell is engineered to express a second CAR. In some embodiments, the second CAR comprises an extracellular domain comprising an ADBD, a transmembrane domain, and an intracellular signaling domain. In an additional embodiment the second CAR is comprised of an extracellular domain composed of one or more ADBDs (e.g., as described in Section VI herein and in Section XI) with the same or different specificities. In some embodiments, the second CAR is able to transduce an effector function signal upon binding a target of interest. In further embodiments, the second CAR comprises an extracellular domain comprising an ADBD, and transmembrane or other cell-surface associating domain, but is unable to signal upon binding a target of interest.

In some embodiments the CAR cell is engineered such that the CAR coding sequence is site specifically introduced into a locus of a gene highly expressed in the corresponding host cell. In some embodiments the CAR coding sequence is introduced into a T cell receptor locus. In further embodiments, the CAR coding sequence is introduced into the cell receptor a constant (MAO of the cell. Modified cells that lack expression of a functional TCR and/or HLA can routinely be obtained using any suitable means known in the art, including for example, siRNA, shRNA, CRISPR, TALEN, and/or ZFN.

In some embodiments, the immune effector cell can be an allogeneic immune effector cell, e.g., T cell or NK cell.

VIIa. Genetic Modifications of CAR Cells

To avoid or reduce the possibility that CAR cells disclosed herein target an immune response (e.g., kill) to themselves, a CAR cell can be genetically modified to reduce or eliminate the expression of one or more AD targeted by the CAR cell directly by a CAR provided herein or indirectly through an Adaptor provided herein. For example, a CAR cell provided herein with an ADBD that specifically binds to an AD of human CD45 or a CAR cell provided herein suited to be used in combination with an Adapter comprising an ADBD that specifically binds to an AD of human CD45 can be engineered to reduce or eliminate the expression of the human CD45 AD recognized by the ADBD. In some embodiments, the CAR cell is a human immune effector cell.

In some embodiments, the CAR cell comprises a genetic modification that reduces or eliminates the expression of one AD bound by a CAR or Adapter provided herein. In some embodiments, the CAR cell comprises a genetic modification that reduces or eliminates the expression of more than one AD bound by a CAR or Adapter provided herein. In some embodiments, the CAR cell comprises more than one genetic modification that reduces or eliminates the expression of more than one AD bound by a CAR or Adapter provided herein. In some embodiments, the more then one AD is comprised by a single antigen. In some embodiments, the AD is a human CD45 AD. In some embodiments, the AD is a human CD26, CD30, CD33, or CD38 AD. In some embodiments, the CAR cell is a human immune effector cell.

In some embodiments, the genetic modification reduces expression of the AD by about 50%, about 60%, about 70%, about 80%, about 90%, about 95% compared to a reference cell without the genetic modification. In some embodiments, the genetic modification eliminates expression of the AD.

In some embodiments, the genetic modification reduces expression of the polypeptide comprising the AD by about 50%, about 60%, about 70%, about 80%, about 90%, about 95% compared to a reference cell without the genetic modification. In some embodiments, the genetic modification eliminates expression of the polypeptide comprising the AD. In some embodiments, the AD is a human CD45 AD. In some embodiments, the AD is a human CD26, CD30, CD33, or CD38 AD.

In some embodiments, the genetic modification is a deletion, insertion, or substitution in a gene or fragment thereof encoding the AD. In some embodiments, the genetic modification is a deletion, insertion, or substitution in a gene or fragment thereof encoding the AD that eliminates expression of the AD. In some embodiments, the AD is a human CD45 AD. In some embodiments, the AD is a human CD26, CD30, CD33, or CD38 AD.

In some embodiments, the genetic modification is a substitution of a gene or fragment thereof encoding a polypeptide comprising the AD with a nucleotide sequence encoding a homologue, variant, or derivative of the polypeptide comprising the AD, wherein the encoded homologue, variant, or derivative does not comprise the AD. In some embodiments, the homologue is a non-human primate homologue. In some embodiments, the homologue is derived from rhesus macaque. In some embodiments, the homologue is derived from cynomolgus monkey. In some embodiments, the variant is a naturally occurring variant. In some embodiments, the variant is a splice variant. In some embodiments, the variant has altered glycosylation pattern. In some embodiments, the variant or derivative is capable of signaling. In some embodiments, the AD is a human CD45 AD. In some embodiments, the AD is a human CD26, CD30, CD33, or CD38 AD.

The genetic modification can reduce or eliminate the expression of any AD for which it is desirable for a CAR or an Adapter to bind, e.g., any of the ADs described in Section IIa and in Section XI.

The production of CAR cells comprising a genetic modification useful in practicing the provided methods may be carried out using a variety of standard techniques for recombinant DNA methodologies, genetic manipulation, and genome editing known in the art. Genetically modified CAR cells described herein that lack expression of an AD can routinely be obtained using any suitable means known in the art, including for example, siRNA, shRNA, CRISPR, TALEN, and/or ZFN. Methods for genetic manipulation of CAR cells is described, for example, in U.S. Patent Appl. Pub. 20170204372, which is incorporated herein by reference in its entirety.

In some embodiments the CAR cell is engineered to eliminate or reduce the expression of a functional T cell receptor (TCR) and/or human leukocyte antigen (HLA), e.g., HLA class I and/or HLA class II. Modified cells that lack expression of a functional TCR and/or HLA can routinely be obtained using any suitable means known in the art, including for example, siRNA, shRNA, CRISPR, TALEN, and/or ZFN.

In some embodiments, the CAR cell is engineered to eliminate or reduce the expression of a molecule that may decrease the ability of a CAR cell to mount an immune effector response. In further embodiments, the CAR cell is engineered to eliminate or reduce the expression of a molecule selected from: PD1, PDL1, CTLA4, TIM3, LAG3, VISTA, BTLA, TIGIT, LAIR1, CD160, 2B4 and TGFR beta. In some embodiments, the CAR cell has been engineered to eliminate or reduce the expression of 2, 3, 4, 5 or more of the above molecules. Modified cells that lack expression of one or more of the above molecules can routinely be obtained using any suitable means known in the art, including for example, siRNA, shRNA, CRISPR, TALEN, and/or ZFN.

In further embodiments, the CAR cell is engineered to eliminate or reduce the expression of one or more of (a) a functional TCR and an HLA; and (b) a molecule selected from: PD1, PDL1, CTLA4, TIM3, LAG3, VISTA, BTLA, TIGIT, LAIR1, CD160, 2B4 and TGFR beta. In further embodiments, the CAR cell has been engineered to eliminate or reduce the expression of 2, 3, 4, 5, 6 or more of the above molecules.

VIII. Compositions

Described herein are compositions comprising a CAR cell (e.g., as described in Section VII and Section XI) and an Adapter (e.g., as described in Section V and Section XI).

For example, in one embodiment a composition comprises (a) a cell expressing a chimeric antigen receptor (CAR), wherein the CAR comprises (i) an antigenic determinant binding domain (ADBD) that binds to a first antigenic determinant (AD) on a target cell, (ii) a transmembrane domain, and (iii) an intracellular domain; and (b) an Adapter which comprises (i) said first AD and (ii) an ADBD that binds to a second AD on said target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In one embodiment, a composition comprises (a) a cell expressing a chimeric antigen receptor (CAR), wherein the CAR comprises (i) an antigenic determinant binding domain (ADBD) that binds to a first antigenic determinant (AD) on a target cell, (ii) a transmembrane domain, and (iii) an intracellular domain; and (b) an Adapter which comprises (i) said first AD and (ii) an ADBD that binds to a second AD on a second target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In one embodiment, a composition comprises (a) a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and (b) an Adapter which comprises (i) said first AD and (ii) an ADBD that binds to a second AD on a target cell. The CAR cell can be any CAR cell described herein (e.g., as described in Section VII and Section XI) and/or the Adapter can be any Adapter described herein (e.g., as described in Section V and Section XI). In some embodiments, the binding of the Adapter cross-links the second AD on the target cell or complexes containing the second AD. In some embodiments, the Adapter contains an ADBD that is derived from a non-naturally occurring scaffold. In some embodiments, the Adapter contains an AD that is not expressed by the target cell. In some embodiments the Adapter contains an AD is on a secreted protein. In some embodiments the Adapter contains an alfafetoprotein AD. In some embodiments, the AD of the Adapter is not a nuclear protein. In some embodiments, the CAR cell comprises a genetic modification that eliminates the expression of the first or second AD.

In one embodiment, a composition comprises (a) a cell expressing a chimeric antigen receptor (CAR), wherein the CAR comprises (i) an antigenic determinant binding domain (ADBD) that is an alternative scaffold binding domain (ASBD) that binds to a first antigenic determinant (AD), (ii) a transmembrane domain, and (iii) an intracellular domain; and (b) an Adapter which comprises (i) said first AD and (ii) an ADBD that binds to a second AD on a target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In one embodiment, a composition comprises (a) a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and (b) an Adapter which comprises (i) said first AD and (ii) an ADBD comprising an ASBD that binds to a second AD on a target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In one embodiment a composition comprises (a) a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; (b) an Adapter which comprises (i) said first AD and (ii) a D domain that binds to a second AD on a target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In one embodiment, the composition comprises (a) a cell expressing a chimeric antigen receptor (CAR), wherein the CAR comprises (i) a D domain that binds to a first antigenic determinant (AD), (ii) a transmembrane domain, and (iii) an intracellular domain; and (b) an Adapter which comprises (i) said first AD and (ii) an ADBD that binds to a second AD on a target cell. The CAR cell can be any CAR cell described herein (e.g., as described in Section VII and Section XI) and/or the Adapter can be any Adapter described in Section V and Section XI. In some embodiments, the CAR cell comprises a genetic modification that eliminates the expression of the first or second AD.

In one embodiment, a composition comprises (a) a cell expressing a chimeric antigen receptor (CAR), wherein the CAR comprises (i) a first D domain that binds to a first antigenic determinant (AD), (ii) a transmembrane domain, and (iii) an intracellular domain; and (b) an Adapter which comprises (i) said first AD and (ii) a second D domain that binds to a second AD on a target cell. The CAR cell can be any CAR cell described herein (e.g., as described in Section VII and Section XI) and/or the Adapter can be any Adapter described herein (e.g., as described in Section V and Section XI). In some embodiments, the CAR cell comprises a genetic modification that eliminates the expression of the first or second AD.

In certain embodiments, the CAR comprises a single-chain variable fragment (scFv) ADBD. In other embodiments, the CAR comprises an alternative scaffold binding domain (ASBD) ADBD. In further embodiments, the CAR comprises a D domain.

In some embodiments, the CAR comprises 2 ADBDs. In other embodiments, the CAR comprises an ASBD and a scFv. In further embodiments, the CAR comprises a D domain and a scFv. In some embodiments, the CAR comprises 2 ASBDs. In further embodiments, the CAR comprises 2 D domains.

In some embodiments, the CAR intracellular domain is a signaling domain. In further embodiments, the CAR intracellular domain comprises a primary signaling domain. In certain embodiments, the CAR intracellular domain comprises a CD3 primary signaling domain. In some embodiments, the CAR intracellular domain further comprises a costimulatory signaling domain. In further embodiments, the costimulatory signaling domain is selected from: CD28, 41BB, CD27, and CD134. In particular embodiments, the CAR intracellular signaling domain comprises a 41BB costimulatory signaling domain.

In some embodiments, the CAR binds to an antigen selected from: CD45, CD26, CD30, CD33, and CD38. In some embodiments, the CAR binds to CD26. In some embodiments, the CAR binds to CD30. In some embodiments, the CAR binds to CD33. In some embodiments, the CAR binds to CD38. In further embodiments, the CAR binds to CD45.

In some embodiments, the CAR binds to an antigen selected from: CD19, CD22, CD123, BCMA, CS1, HER2, TACI, BAFFR, and PDL1. In further embodiments, the CAR binds to BCMA. In further embodiments, the CAR binds to CS1. In other embodiments, the CAR binds to CD123. In other embodiments, the CAR binds to CD19. In other embodiments, the CAR binds to CD22. In other embodiments, the CAR binds to TACI. In other embodiments, the CAR binds to BAFFR. In other embodiments, the CAR binds to PDL1. In other embodiments, the CAR binds to HER2.

In some embodiments, the CAR comprises 2 ADBDs that bind to separate targets. In further embodiments, the CAR binds to BCMA and CS1. In further embodiments, the CAR binds to CD19 and CD123. In other embodiments, the CAR binds to CD22 and CD123. In other embodiments, the CAR binds to PDL1 and CD123. In some embodiments, the CAR binds to CD45 and a second target. In certain embodiments, the CAR comprises a first ASBD that binds to BCMA and a second ASBD that binds to CS1. In other embodiments, the CAR comprises a first D domain that binds to BCMA and a second D domain that binds to CS1. In other embodiments, the CAR comprises a D domain that binds to BCMA and a scFv that binds to CS1. In other embodiments, the CAR comprises a D domain that binds to CS1 and a scFv that binds to BCMA. In certain embodiments, the CAR comprises a first ASBD that binds to CD19 and a second ASBD that binds to CD123. In other embodiments, the CAR comprises a first D domain that binds to CD19 and a second D domain that binds to CD123. In some embodiments, the CAR comprises a first D domain that binds to a CD45 AD and a second D domain that binds to a second AD. In other embodiments, the CAR comprises a D domain that binds to CD19 and a scFv that binds to CD123. In other embodiments, the CAR comprises a first ASBD that binds to CD22 and a second ASBD that binds to CD123. In other embodiments, the CAR comprises a first D domain that binds to CD22 and a second D domain that binds to CD123. In other embodiments, the CAR comprises a D domain that binds to CD22 and a scFv that binds to CD123. In some embodiments, the CAR comprises a first ASBD that binds to PDL1 and a second ASBD that binds to CD123. In some embodiments, the CAR comprises a first D domain that binds to PDL1 and a second D domain that binds to CD123. In some embodiments, the CAR comprises a D domain that binds to PDL1 and a scFv that binds to CD123. In some embodiments, the CAR comprises an ASBD that binds to CD19 and a scFv that binds to CD123.

In some embodiments, the Adapter comprises an AD of a tumor antigen. In further embodiments, the tumor antigen is selected from the group: BCMA, CD123, CD19, CD22, CS1, TACI, BAFFR, and PDL1. In further embodiments, the tumor antigen is HER2.

In some embodiments, the Adapter comprises an ADBD that is a scFv. In further embodiments, the Adapter comprises an ADBD that is an ASBD. In some embodiments, the Adapter comprises a D domain.

In some embodiments, the Adapter comprises two ADBDs. In further embodiments, the Adapter comprises two ADBDs that (a) are the same, (b) bind to the same antigenic determinant, (c) bind to different ADs of the same antigen, (d) bind to different antigens on the same cell, or (d) bind to different antigens on different cells. In further embodiments, the Adapter comprises two ASBDs. In certain embodiments, the Adapter comprises two D domains. In some embodiments, the Adapter comprises an ADBD that is a scFv and an ADBD that is an ASBD. In other embodiments, the Adapter comprises an ADBD that is a scFv and an ADBD that is a D domain.

In some embodiments, the Adapter comprises an ADBD that binds to a member selected from: CD45, CD26, CD30, CD33, and CD38. In certain embodiments, the Adapter comprises an ADBD binds to CD45. In other embodiments, the Adapter comprises an ADBD that binds to CD26. In some embodiments, the Adapter comprises an ADBD that binds to CD30. In other embodiments, the Adapter comprises an ADBD that binds to CD33. In other embodiments, the Adapter comprises an ADBD that binds to CD38. In some embodiments, the Adapter comprises an ADBD that binds to CD45.

In some embodiments, the Adapter comprises an ADBD that binds to a member selected from: BCMA, CD123, CD19, CD22, CS1, HER2, TACI, BAFFR, and PDL1. In certain embodiments, the Adapter comprises an ADBD binds to BCMA. In other embodiments, the Adapter comprises an ADBD that binds to CD123. In some embodiments, the Adapter comprises an ADBD that binds to CD19.

In other embodiments, the Adapter comprises an ADBD that binds to CD22. In other embodiments, the Adapter comprises an ADBD that binds to CS1. In other embodiments, the Adapter comprises an ADBD that binds to HER2. In other embodiments, the Adapter comprises an ADBD that binds to TACI. In other embodiments, the Adapter comprises an ADBD that binds to BAFFR. In other embodiments, the Adapter comprises an ADBD that binds to PDL1.

In some embodiments, the Adapter is bispecific. In further embodiments, the Adapter comprises an ADBD that binds to CD19 and an ADBD that binds to CD123. In other embodiments, the Adapter comprises an ADBD that binds to BCMA and an ADBD that binds to CS1. In other embodiments, the Adapter comprises an ADBD that binds to CD22 and an ADBD that binds to CD123. In other embodiments, the Adapter comprises an ADBD that binds to PDL1 and an ADBD that binds to CD123. In some embodiments, the Adapter binds to a human CD45 AD and a second AD.

In some embodiments, the target cell is a tumor cell. In further embodiments, the tumor cell is selected from the group: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In further embodiments, the tumor cell is selected from the group: acute myeloid leukemia (AML), chronic lymphocytic leukemia (CLL), and multiple myeloma (MM). In some embodiments, the tumor cell is an AML tumor cell. In some embodiments, the tumor cell is an CLL tumor cell. In some embodiments, the tumor cell is an MM tumor cell.

In some embodiments, the target cell is a cancer cell. In further embodiments, the cancer cell is selected from the group: breast cancer, prostate cancer, ovarian cancer, pancreatic cancer, colon cancer, and lung cancer. In further embodiments, the cancer cell is breast cancer. In some embodiments, the cancer cell is ovarian cancer.

In some embodiments, the composition comprises at least two target cells. In some embodiments, at least one target cell is a tumor cell. In further embodiments, the first and second target cells are tumor cells. In certain embodiments, the first and second tumor cells are of the same tumor type. In other embodiments, the first and second tumor cells are of a different tumor type. In some embodiments, the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In some embodiments, the tumor cells are selected from: acute myeloid leukemia (AML), chronic lymphocytic leukemia (CLL), and multiple myeloma (MM).

In some embodiments, the cell expressing the CAR is an immune effector cell. In further embodiments, the immune effector cell is a T cell. In other embodiments, the immune effector cell is an NK cell. In some embodiments, the cell expressing the CAR kills the target cell. In some embodiments, binding of the Adapter to an AD blocks the activity of the antigen comprising the AD. In some embodiments, the cell expressing the CAR comprises a genetic modification that reduces or eliminates the expression of an AD described herein. In some embodiments, the cell expressing the CAR comprises a genetic modification that reduces or eliminates the expression of a human CD45 AD.

In one embodiment, the composition is within a patient, e.g., a human patient.

In some embodiments, the CAR cell binds to an AD that is present on both a target cell and an Adapter. In other embodiments, the CAR cell binds to an AD that is present on an Adapter, but is not present on a target cell. In some embodiments, the AD is a naturally occurring protein/molecule. In some embodiments, the AD is a human protein/molecule.

IX. Methods that Comprise Contacting a Target Cell

Described herein are methods of use comprising contacting a target cell with a CAR cell (e.g., as described above in Section VII and Section XI) and an Adapter (e.g., as described above in Section V and Section XI) or a composition (e.g., as described above in Section VIII and Section XI).

For example, in one embodiment, a method of delivering an immune response to a target cell comprises contacting the target cell with any of the compositions described herein (e.g., as described in Section VIII and Section XI). In another embodiment, a method of killing a target cell comprises contacting the target cell with any of the compositions described herein (e.g., as described in Section VIII and Section XI). As used herein, "contacting" can refer to contacting a target cell in vitro (e.g., in a cell culture) or contacting a target cell in vivo (e.g., in a patient).

In one embodiment, a method of delivering an immune response to a target cell comprises contacting a composition comprising a target cell with an Adapter, wherein (a) the composition comprising the target cell further comprises a cell expressing a CAR, wherein the CAR comprises (i) an antigenic determinant binding domain (ADBD) that binds to a first AD on said target cell, (ii) a transmembrane domain, and (iii) an intracellular domain; and (b) the Adapter comprises (i) said first AD and (ii) an ADBD that binds to a second AD on said target cell.

In one embodiment, a method of delivering an immune response to one or more target cells comprises contacting a composition comprising a first target cell with an Adapter, wherein (a) the composition comprising the target cell further comprises a cell expressing a chimeric antigen receptor (CAR), wherein the CAR comprises (i) an antigenic determinant binding domain (ADBD) that binds to a first AD on said first target cell, (ii) a transmembrane domain, and (iii) an intracellular domain; and (b) the Adapter comprises (i) said first AD and (ii) an ADBD that binds to a second AD on a second target cell.

In one embodiment, method of delivering an immune response to a target cell comprises contacting a composition comprising a target cell with an Adapter, wherein (a) the composition comprising the target cell further comprises a cell expressing a chimeric antigen receptor (CAR), wherein the CAR comprises (i) an antigenic determinant binding domain (ADBD) that is an ASBD that binds to a first AD, (ii) a transmembrane domain, and (iii) an intracellular domain; and (b) the Adapter comprises (i) said first AD and (ii) an ADBD that binds to a second AD on said target cell.

In one embodiment, a method of delivering an immune response to a target cell comprises contacting a composition comprising a target cell with an Adapter, wherein (a) the composition comprising the target cell further comprises a cell expressing a chimeric antigen receptor (CAR), wherein the CAR comprises (i) an antigenic determinant binding domain (ADBD) that binds to a first AD, (ii) a transmembrane domain, and (iii) an intracellular domain; and (b) the Adapter comprises (i) said first AD and (ii) an ADBD that is an ASBD that binds to a second AD on said target cell.

In one embodiment, a method of delivering an immune response to a target cell comprises contacting a composition comprising a target cell with a cell expressing a chimeric antigen receptor (CAR), wherein (a) a first antigenic determinant (AD) is present on the target cell; (b) the composition comprising the first target cell further comprises an Adapter comprising (i) said first AD and (ii) an antigenic determinant binding domain (ADBD) that binds to a second AD on the target cell; and (c) the CAR comprises (i) an ADBD that binds to said first AD on the target cell or the Adapter, (ii) a transmembrane domain, and (iii) an intracellular domain.

In one embodiment, a method of delivering an immune response to one or more target cells comprises contacting a composition comprising a target cell with a cell expressing a chimeric antigen receptor (CAR), wherein (a) a first AD is present on the first target cell; (b) the composition comprising the first target cell further comprises a second target cell and an Adapter comprising (i) said first AD and (ii) an antigenic determinant binding domain (ADBD) that binds to a second AD on a second target cell; and (c) the CAR comprises (i) an ADBD that binds to said first AD on the first target cell or the Adapter, (ii) a transmembrane domain, and (iii) an intracellular domain.

In one embodiment, a method of delivering an immune response to a target cell comprises contacting a composition comprising a target cell with a cell expressing a chimeric antigen receptor (CAR), wherein (a) a first antigenic determinant (AD) is present on the target cell; (b) the composition comprising the target cell further comprises an Adapter comprising (i) an antigenic determinant binding domain (ADBD) that binds to said first AD on said target cell and (ii) a second AD; and (c) the CAR comprises (i) an ADBD that is an ASBD that binds to said second AD, (ii) a transmembrane domain, and (iii) an intracellular domain.

In one embodiment, a method of delivering an immune response to a target cell comprises contacting a composition comprising a target cell with a cell expressing a chimeric antigen receptor (CAR), wherein (a) a first antigenic determinant (AD) is present on the target cell; (b) the composition comprising the target cell further comprises an Adapter comprising (i) an antigenic determinant binding domain (ADBD) that is an ASBD that binds to said first AD on said target cell and (ii) a second AD; and (c) the CAR comprises (i) an ADBD that binds to said second AD, (ii) a transmembrane domain, and (iii) an intracellular domain.

In one embodiment, a method of killing a target cell comprises contacting a composition comprising a target cell with an Adapter, wherein (a) the composition comprising the target cell further comprises a cell expressing a CAR, wherein the CAR comprises (i) an antigenic determinant binding domain (ADBD) that binds to a first AD on said target cell, (ii) a transmembrane domain, and (iii) an intracellular domain; and (b) the Adapter comprises (i) said first AD and (ii) an ADBD that binds to a second AD on said target cell.

In one embodiment, a method of killing one or more target cells comprising contacting a composition comprising a first target cell with an Adapter, wherein, wherein (a) the composition comprising the target cell further comprises a cell expressing a chimeric antigen receptor (CAR), wherein the CAR comprises (i) an antigenic determinant binding domain (ADBD) that binds to a first AD on said first target cell, (ii) a transmembrane domain, and (iii) an intracellular domain; and (b) the Adapter comprises (i) said first AD and (ii) an ADBD that binds to a second AD on a second target cell.

In one embodiment, a method of killing a target cell comprises contacting a composition comprising a target cell with an Adapter, wherein (a) the composition comprising the target cell further comprises a cell expressing a chimeric antigen receptor (CAR), wherein the CAR comprises (i) an antigenic determinant binding domain (ADBD) that is an ASBD that binds to a first AD, (ii) a transmembrane domain, and (iii) an intracellular domain; and (b) the Adapter comprises (i) said first AD and (ii) an ADBD that binds to a second AD on said target cell.

In one embodiment, a method of killing a target cell comprises contacting a composition comprising a target cell with an Adapter, wherein (a) the composition comprising the target cell further comprises a cell expressing a chimeric antigen receptor (CAR), wherein the CAR comprises (i) an antigenic determinant binding domain (ADBD) that binds to a first AD, (ii) a transmembrane domain, and (iii) an intracellular domain; and (b) the Adapter comprises (i) said first AD and (ii) an ADBD that is an ASBD (e.g., D domain) that binds to a second AD on said target cell.

In one embodiment, a method of killing a target cell comprises contacting a composition comprising a target cell with a cell expressing a CAR, wherein (a) a first AD is present on the target cell; (b) the composition comprising the target cell further comprises an Adapter comprising (i) said first AD and (ii) an ADBD that binds to a second AD on the target cell and (c) the comprises (i) an ADBD that binds to said first AD on the target cell or the Adapter, (ii) a transmembrane domain, and (iii) an intracellular domain.

In one embodiment, a method of killing one or more target cells comprises contacting a composition comprising a target cell with a cell expressing a CAR, wherein (a) a first AD is present on the first target cell, (b) the composition comprising a first target cell further comprises a second target cell and an Adapter comprising (i) said first AD and (ii) an ADBD that binds to a second AD on the second target cell; and (c) the CAR comprises (i) an ADBD that binds to said first AD on the first target cell or the Adapter, (ii) a transmembrane domain, and (iii) an intracellular domain.

In one embodiment, a method of killing a target cell comprises contacting a composition comprising a target cell with a cell expressing a CAR, wherein (a) a first AD is present on the target cell; (b) the composition comprising the target cell further comprises an Adapter comprising (i) an ADBD that binds to said first AD on said target cell and (ii) a second AD; and (c) the CAR comprises (i) an ADBD that is an ASBD that binds to said second AD, (ii) a transmembrane domain, and (iii) an intracellular domain.

In one embodiment, a method of killing a target cell comprises contacting a composition comprising a target cell with a cell expressing a CAR, wherein (a) a first AD is present on the target cell; (b) the composition comprising the target cell further comprises an Adapter comprising (i) an antigenic determinant binding domain (ADBD) that is an ASBD that binds to said first AD on said target cell and (ii) a second AD; and (c) the CAR comprises (i) an ADBD that binds to said second AD, (ii) a transmembrane domain, and (iii) an intracellular domain.

The contacting can occur in vitro, ex vivo, or in vivo. In one embodiment, the contacting occurs in a patient, e.g. a human patient, for example after administration of an Adapter to a patient who has received a cell expressing a CAR or after administration of a cell expressing a CAR to a patient who has received an Adapter.

In some embodiments, the CAR cell comprises a genetic modification that eliminates the expression of an AD recognized by a CAR described herein or by an Adapter described herein. In some embodiments, the AD is a human CD45 AD. In some embodiments, the CAR cell comprises a genetic modification that eliminates the expression of the AD recognized by the CAR or by an Adapter bound by the CAR. In some embodiments, the AD is a human CD45 AD.

In certain embodiments, the CAR comprises a single-chain variable fragment (scFv) ADBD. In other embodiments, the CAR comprises an alternative scaffold binding domain (ASBD) ADBD. In further embodiments, the CAR comprises a D domain.

In some embodiments, the CAR comprises 2 ADBDs. In other embodiments, the CAR comprises an ASBD and a scFv. In further embodiments, the CAR comprises a D domain and a scFv. In some embodiments, the CAR comprises 2 ASBDs. In further embodiments, the CAR comprises 2 D domains.

In some embodiments, the CAR intracellular domain is a signaling domain. In further embodiments, the CAR intracellular domain comprises a primary signaling domain. In certain embodiments, the CAR intracellular domain comprises a CD3 primary signaling domain. In some embodiments, the CAR intracellular domain further comprises a costimulatory signaling domain. In further embodiments, the costimulatory signaling domain is selected from: CD28, 41BB, CD27, and CD134. In particular embodiments, the CAR intracellular signaling domain comprises a 41BB costimulatory signaling domain.

In some embodiments, the CAR binds to an antigen selected from: CD45, CD26, CD30, CD33, and CD38. In further embodiments, the CAR binds to CD26. In other embodiments, the CAR binds to CD30. In other embodiments, the CAR binds to CD33. In other embodiments, the CAR binds to CD38. In some embodiments, the CAR binds to CD45.

In some embodiments, the CAR binds to an antigen selected from: CD19, CD22, CD123, BCMA, CS1, HER2, TACI, BAFFR, and PDL1. In further embodiments, the CAR binds to BCMA. In other embodiments, the CAR binds to CS1. In other embodiments, the CAR binds to CD123. In other embodiments, the CAR binds to CD19. In other embodiments, the CAR binds to CD22. In other embodiments, the CAR binds to TACI. In other embodiments, the CAR binds to BAFFR. In other embodiments, the CAR binds to PDL1. In other embodiments, the CAR binds to HER2.

In some embodiments, the CAR comprises 2 ADBDs that bind to separate targets. In further embodiments, the CAR binds to CD19 and CD123. In other embodiments, the CAR binds to BCMA and CS1. In other embodiments, the CAR binds to CD22 and CD123. In other embodiments, the CAR binds to PDL1 and CD123. In some embodiments, the CAR binds to CD45 and second target. In certain embodiments, the CAR comprises a first ASBD that binds to CD19 and a second ASBD that binds to CD123. In other embodiments, the CAR comprises a first D domain that binds to CD19 and a second D domain that binds to CD123. In certain embodiments, the CAR comprises a first ASBD that binds to BCMA and a second ASBD that binds to CS1. In other embodiments, the CAR comprises a first D domain that binds to BCMA and a second D domain that binds to CS1. In other embodiments, the CAR comprises a D domain that binds to CS1 and a scFv that binds to BCMA. In some embodiments, the CAR comprises a first D domain that binds to a CD45 AD and a second D domain that binds to a second AD. In other embodiments, the CAR comprises a D domain that binds to CD19 and a scFv that binds to CD123. In other embodiments, the CAR comprises a first ASBD that binds to CD22 and a second ASBD that binds to CD123. In other embodiments, the CAR comprises a first D domain that binds to CD22 and a second D domain that binds to CD123. In other embodiments, the CAR comprises a D domain that binds to CD22 and a scFv that binds to CD123. In some embodiments, the CAR comprises a first ASBD that binds to PDL1 and a second ASBD that binds to CD123. In some embodiments, the CAR comprises a first D domain that binds to PDL1 and a second D domain that binds to CD123. In some embodiments, the CAR comprises a D domain that binds to PDL1 and a scFv that binds to CD123. In some embodiments, the CAR comprises an ASBD that binds to CD19 and a scFv that binds to CD123.

In some embodiments, the Adapter comprises an AD of a tumor antigen. In further embodiments, the tumor antigen is selected from the group: CD45, CD26, CD30, CD33, and CD38.

In some embodiments, the Adapter comprises an AD of a tumor antigen. In further embodiments, the tumor antigen is selected from the group: BCMA, CD123, CD19, CD22, CS1, HER2, TACI, BAFFR, and PDL1.

In some embodiments, the Adapter comprises an ADBD that is a scFv. In further embodiments, the Adapter comprises an ADBD that is an ASBD. In some embodiments, the Adapter comprises a D domain.

In some embodiments, the Adapter comprises two ADBDs. In further embodiments, the Adapter comprises two ADBDs that (a) are the same, (b) bind to the same antigenic determinant, (c) bind to different ADs of the same antigen, (d) bind to different antigens on the same cell, or (e) bind to different antigens on different cells. In some embodiments, the Adapter comprises two ASBDs. In certain embodiments, the Adapter comprises two D domains. In some embodiments, the Adapter comprises an ADBD that is a scFv and an ADBD that is an ASBD. In other embodiments, the Adapter comprises an ADBD that is a scFv and an ADBD that is a D domain.

In some embodiments, the Adapter comprises an ADBD that binds to a member selected from: CD45, CD26, CD30, CD33, and CD38. In certain embodiments, the Adapter comprises an ADBD binds to CD26. In other embodiments, the Adapter comprises an ADBD that binds to CD30. In some embodiments, the Adapter comprises an ADBD that binds to CD38. In other embodiments, the Adapter comprises an ADBD that binds to CD45.

In some embodiments, the Adapter comprises an ADBD that binds to a member selected from: BCMA, CD123, CD19, CD22, CS1, HER2, TACI, BAFFR, and PDL1. In certain embodiments, the Adapter comprises an ADBD binds to BCMA. In other embodiments, the Adapter comprises an ADBD that binds to CD123. In some embodiments, the Adapter comprises an ADBD that binds to CD19. In other embodiments, the Adapter comprises an ADBD that binds to CD22. In other embodiments, the Adapter comprises an ADBD that binds to CS1. In other embodiments, the Adapter comprises an ADBD that binds to HER2. In other embodiments, the Adapter comprises an ADBD that binds to TACI. In other embodiments, the Adapter comprises an ADBD that binds to BAFFR. In other embodiments, the Adapter comprises an ADBD that binds to PDL1.

In some embodiments, the Adapter is bispecific. In further embodiments, the Adapter comprises an ADBD that binds to CD19 and an ADBD that binds to CD123. In other embodiments, the Adapter comprises an ADBD that binds to BCMA and an ADBD that binds to CS1. In other embodiments, the Adapter comprises an ADBD that binds to CD22 and an ADBD that binds to CD123. In other embodiments, the Adapter comprises an ADBD that binds to PDL1 and an ADBD that binds to CD123. In some embodiments, the Adapter binds to a human CD45 AD and a second AD.

In some embodiments, the target cell is a tumor cell. In further embodiments, the tumor cell is selected from the group: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In further embodiments, the tumor cell is selected from the group: acute myeloid leukemia (AML), chronic lymphocytic leukemia (CLL), and multiple myeloma (MM). In some embodiments, the tumor cell is an AML tumor cell. In some embodiments, the tumor cell is an CLL tumor cell. In some embodiments, the tumor cell is an MM tumor cell.

In some embodiments, the composition comprises at least two target cells. In some embodiments, at least one target cell is a tumor cell. In further embodiments, the first and second target cells are tumor cells. In certain embodiments, the first and second tumor cells are of the same tumor type. In other embodiments, the first and second tumor cells are of a different tumor type. In some embodiments, the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In some embodiments, the tumor cells are selected from: acute myeloid leukemia (AML), chronic lymphocytic leukemia (CLL), and multiple myeloma (MM). In some embodiments, the tumor cells are multiple myeloma (MM). In the methods of killing a target cell provided herein, the target cell can be a cancer cell. Exemplary cancer cells the can be targeted according to the methods provided herein are discussed in Section X and Section XI.

In some embodiments, the target cell is a tumor cell. In further embodiments, the tumor cell is selected from the group: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In some embodiments, the tumor cell is selected from: acute myeloid leukemia (AML), chronic lymphocytic leukemia (CLL), and multiple myeloma (MM). In some embodiments, the tumor cell is multiple myeloma (MM).

In some embodiments, the target cell is a cancer cell. In further embodiments, the cancer cell is selected from the group: breast cancer, prostate cancer, ovarian cancer, pancreatic cancer, colon cancer, and lung cancer. In some embodiments, the cancer cell is breast cancer. In some embodiments, the cancer cell is ovarian cancer.

In some embodiments, the composition comprises at least two target cells. In some embodiments, at least one target cell is a tumor cell. In further embodiments, the first and second target cells are tumor cells. In certain embodiments, the first and second tumor cells are of the same tumor type. In other embodiments, the first and second tumor cells are of a different tumor type. In some embodiments, the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In some embodiments, the tumor cells are selected from: acute myeloid leukemia (AML), chronic lymphocytic leukemia (CLL), and multiple myeloma (MM). In some embodiments, the tumor cells are multiple myeloma (MM).

In the methods of killing a target cell provided herein, the target cell can be a cell of the immune system. In some embodiments, the target cell is a B cell. In some embodiments, the target cell is a T cell. In some embodiments, the target cell is a naïve T cell. In some embodiments, the target cell is a memory T cell.

In the methods of killing a target cell provided herein, the target cell can be a bacterial cell (e.g., tuberculosis, smallpox, and anthrax), a cell of a parasite (e.g., malaria or leishmaniosis) a fungal cell, a mold, a *Mycoplasma*, or a cell infected with a virus (e.g., HIV, hepatitis b, rabies, Nipah virus, west Nile virus, a meningitis virus, or CMV).

In some embodiments, the cell expressing the CAR is an immune effector cell. An immune effector cell is a cell that is involved in an immune response, e.g., in the promotion of an immune effector response. Examples of immune effector cells include T cells (e.g., alpha/beta T cells and gamma/delta T cells), B cells, natural killer (NK) cells, natural killer T (NKT) cells, mast cells, and myeloid-derived phagocytes. An immune effector function or immune effector response is a function or response of for example, an immune effector cell that enhances or promotes an immune attack of a target cell. In some embodiments, the immune effector function or response refers a property of a T or NK cell that promotes killing, or the inhibition of growth or proliferation, of a target cell. For example, primary stimulation and costimulation are examples of immune effector function or response of a T cell. In particular embodiments, an immune effector function or response is promoted by the action of the disclosed CAR, Adapter, and/or CAR and Adapter compositions. Such function or response results in, for example, a CAR cell that is more effective at proliferation, cytokine production, cytotoxicity or upregulation of cell surface markers such as CD25, CD69, and CD107a.

In some embodiments, the immune effector cell is a T cell. In other embodiments, the immune effector cell is an NK cell. In some embodiments, the cell expressing the CAR kills the target cell. In some embodiments, binding of the Adapter to an AD blocks the activity of the antigen comprising the AD.

In some embodiments, the CAR cell kills the target cell upon direct binding to the target cell. In some embodiments, the CAR cell kills the target cell upon binding to the Adapter, wherein the Adapter is bound to the target cell (e.g., as depicted in FIGS. 3A-3C).

In some embodiments, binding of CAR to the target cell and/or to the Adapter results in intracellular signaling in the cell expressing the CAR.

In some embodiments, binding of the CAR to the target cell and/or to the Adapter results in degranulation. Degranulation can result in the release of, depending on the cell type, antimicrobial, cytotoxic or other molecules from secretory granules in the immune cell. Molecules like perforin (a pore forming cytotoxin) or granzymes (serine proteases that induce apoptosis in the target cell) aid T cells and NK cells in killing tumor cells (or other cell types).

In some embodiments, binding of the CAR to the target cell and/or to the Adapter results in cytokine secretion by the cell expressing the CAR. The cytokine can be, for example, interferon gamma (IFNγ).

In some embodiments, binding of the CAR to the target cell and/or to the Adapter results in proliferation of the cell expressing the CAR.

X. Therapeutic Uses

Described herein are methods of delivering an immune response to a target cell in a patient and/or killing a target cell in a patient comprising administering an Adapter (as described herein (e.g., as described in Section V and Section XI)) and/or a CAR cell described herein (e.g., as described in Section VII and Section XI) to the patient. Also described herein are methods of treating a proliferative disorder, cancer, autoimmune disease, infection, or allograft rejection comprising administering an Adapter described herein (e.g., as described in Section V and Section XI) and/or a CAR cell described herein (e.g., as described in Section VII and Section XI) to the patient. In particular embodiments, provided herein are methods of treating hematological cancer or autoimmune disease comprising administering an Adapter described herein (e.g., as described in Section V and Section XI) and/or a CAR cell described herein (e.g., as described in Section VII and Section XI) to the patient.

In one embodiment, a method of delivering an immune response to a target cell in a patient comprises administering a cell expressing a CAR to the patient. In another embodiment, a method of killing a target cell in a patient comprises administering a cell expressing a CAR to the patient. In another embodiment, a method of depleting lymphocytes in a patient comprises administering a cell expressing a CAR to the patient. In another embodiment, a method of treating a proliferative disorder, cancer, autoimmune disease, infection, or allograft rejection in a patient comprises administering a cell expressing a CAR to the patient. In certain embodiments, a method of treating hematological cancer comprises administering a cell expressing a CAR to the patient. In certain embodiments, a method of treating an autoimmune disease or disorder comprises administering a cell expressing a CAR to the patient. In one embodiment, a first AD is present on the target cell, and the CAR comprises (i) an ADBD that binds to said first AD on the target cell, (ii) a transmembrane domain, and (iii) an intracellular domain. In one embodiment, a first AD is present on the target cell; and the CAR comprises (i) an ADBD that is an ASBD that binds to said first AD, (ii) a transmembrane domain, and (iii) an intracellular domain. In the methods of killing a target cell in a patient comprising administering a cell expressing a CAR the cell expressing a CAR can be any of the cells expressing CARs described herein (e.g., as described in Section VII and Section XI). In the methods of killing a target cell in a patient comprising administering a cell expressing a CAR the cell expressing a CAR can be in a pharmaceutically acceptable composition. In some embodiments, the CAR cell comprises a genetic modification that reduces or eliminates the expression of an AD bound by the CAR.

In one embodiment, a method of delivering an immune response to a target cell in a patient comprises administering an Adapter to the patient. In another embodiment, a method of killing a target cell in a patient comprises administering an Adapter to the patient. In another embodiment, a method of depleting lymphocytes in a patient comprises administering an Adapter to the patient. In another embodiment, a method of treating a proliferative disorder, cancer, autoimmune disease, infection, or allograft rejection in a patient comprises administering an Adapter to the patient. In certain embodiments, a method of treating hematological cancer comprises administering an Adapter to the patient. In certain embodiments, a method of treating an autoimmune disease or disorder comprises administering an Adapter to the patient. In one embodiment, the patient has been treated with a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and the Adapter comprises (i) said first AD and (ii) an ADBD that binds to a second AD on said target cell. In one embodiment, the patient has been treated with a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and the Adapter comprises (i) said first AD and (ii) an ADBD that binds to a second AD on said target cell. In one embodiment, the patient has been treated with a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and the Adapter comprises (i) said first AD and (ii) an ADBD that is an ASBD that binds to a second AD on said target cell. In the methods of killing a target cell in a patient comprising administering an Adapter to a patient, the Adapter can be any of the Adapters described herein (e.g., as described in Section V and Section XI) and/or the patient can have been treated with any of the cells expressing CARS described herein (e.g., as described in Section VII and Section XI). In some embodiments of the methods of killing a target cell in a patient comprising administering an Adapter to a patient, the patient has previously been treated with an Adapter (in addition to the cell expressing a CAR). In some embodiments, the Adapter that is administered to the patient and the Adapter that was previously administered to the patient bind to different ADs (e.g., on the same or different target cells). In the methods of killing a target cell in a patient comprising administering an Adapter to a patient, the Adapter can be in a pharmaceutically acceptable composition. In some embodiments, the CAR cell comprises a genetic modification that reduces or eliminates the expression of an AD bound by the CAR or the Adapter.

In one embodiment, a method of delivering an immune response to a target cell in a patient comprises administering an Adapter to the patient. In another embodiment, a method of killing a target cell in a patient comprises administering an Adapter to the patient. In another embodiment, a method of depleting lymphocytes in a patient comprises administering an Adapter to the patient. In another embodiment, a method of treating a proliferative disorder, cancer, autoimmune disease, infection, or allograft rejection in a patient comprises administering an Adapter to the patient. In certain embodiments, a method of treating hematological cancer comprises administering an Adapter to the patient. In certain embodiments, a method of treating an autoimmune disease or disorder comprises administering an Adapter to the patient. In one embodiment, the patient comprises a cell expressing a chimeric antigen receptor (CAR), wherein the CAR comprises (i) an antigenic determinant binding domain (ADBD) that binds to a first antigenic determinant (AD) on said target cell, (ii) a transmembrane domain, and (iii) an intracellular domain; and the Adapter comprises (i) said first AD and (ii) an ADBD that binds to a second AD on said target cell. In one embodiment, the patient comprises a cell expressing a chimeric antigen receptor (CAR), wherein the CAR comprises (i) an antigenic determinant binding domain (ADBD) that is an ASBD that binds to a first antigenic determinant (AD), (ii) a transmembrane domain, and (iii) an intracellular domain; and the Adapter comprises (i) said first AD and (ii) an ADBD that binds to a second AD on said target cell. In one embodiment, the patient comprises a cell expressing a chimeric antigen receptor (CAR), wherein the CAR comprises (i) an antigenic determinant binding domain (ADBD) that binds to a first antigenic determinant (AD), (ii) a transmembrane domain, and (iii) an intracellular domain; and the Adapter comprises (i) said first AD and (ii) an ADBD that is an ASBD that binds to a second AD on said target cell. In the methods of killing a target cell in a patient comprising administering an Adapter to a patient, the Adapter can be any of the Adapters described herein (e.g., as described in Section V and Section XI) and/or the patient can comprise any of the cells expressing CARS described herein (e.g., as described in Section VII and Section XI). In some embodiments of the methods of killing a target cell in a patient comprising administering an Adapter to a patient, the patient comprises an Adapter (in addition to the cell expressing a CAR). In some embodiments, the Adapter that is administered to the patient and the Adapter comprised by the patient bind to different ADs (e.g., on the same or different target cells). In the methods of killing a target cell in a patient comprising administering an Adapter to a patient, the Adapter can be in a pharmaceutically acceptable composition. In some embodiments, the CAR cell comprises a genetic modification that reduces or eliminates the expression of an AD bound by the CAR or the Adapter.

In one embodiment, a method of redirecting an immune response to a target cell in a patient comprises administering an Adapter to the patient. In another embodiment, a method of redirecting target cell killing in a patient comprises administering an Adapter to the patient. In another embodiment, a method of redirecting lymphocyte depletion in a patient comprises administering an Adapter to the patient. In another embodiment, a method of redirecting treatment of a proliferative disorder, cancer, autoimmune disease, infection, or allograft rejection comprises administering an Adapter to the patient. In certain embodiments, a method of redirecting treatment of a hematological cancer comprises administering an Adapter to the patient. In certain embodiments, a method of redirecting treatment of an autoimmune disease or disorder comprises administering an Adapter to the patient. In one embodiment, the patient has been treated with a cell expressing a CAR, wherein the CAR comprises (i) an antigenic determinant binding domain (ADBD) that binds to a first antigenic determinant (AD) on a first target cell, (ii) a transmembrane domain, and (iii) an intracellular domain; and the Adapter comprises (i) said first AD and (ii) an ADBD that binds to a second AD on a second target cell. In the methods of redirecting target cell killing in a patient comprising administering an Adapter to a patient, the Adapter can be any of the Adapters described herein (e.g., as described in Section V and Section XI) and/or the patient can have been treated with any of the cells expressing CARS described herein (e.g., as described in Section VII and Section XI). In one embodiment, the patient comprises a cell expressing a CAR, wherein the CAR comprises (i) an antigenic determinant binding domain (ADBD) that binds to a first antigenic determinant (AD) on a first target cell, (ii) a transmembrane domain, and (iii) an intracellular domain; and the Adapter comprises (i) said first AD and (ii) an ADBD that binds to a second AD on a second target cell. In the methods of redirecting target cell killing in a patient comprising administering an Adapter to a patient, the Adapter can be any of the Adapters described herein (e.g., as described in Section V and Section XI) and/or the patient can comprise any of the cells expressing CARs described herein (e.g., as described in Section VII and Section XI). In the methods of redirecting target cell killing in a patient comprising administering an Adapter to a patient, the Adapter can be in a pharmaceutically acceptable composition. In some embodiments, the CAR cell comprises a genetic modification that reduces or eliminates the expression of an AD bound by the CAR or the Adapter.

In one embodiment, a method of delivering an immune response to a target cell in a patient comprises administering a cell expressing a CAR to the patient. In another embodiment, a method of killing a target cell in a patient comprises administering a cell expressing a CAR to the patient. In another embodiment, a method of depleting lymphocytes in a patient comprises administering a cell expressing a CAR to the patient. In another embodiment, a method of treating a proliferative disorder, cancer, autoimmune disease, infection, or allograft rejection in a patient comprises administering a cell expressing a CAR to the patient. In certain embodiments, a method of treating hematological cancer comprises administering a cell expressing a CAR to the patient. In certain embodiments, a method of treating an autoimmune disease or disorder comprises administering a cell expressing a CAR to the patient. In one embodiment, a first AD and a second AD are present on the target cell, the patient has been treated with an Adapter comprising (i) said first AD and (ii) an ADBD that binds to the second AD on said target cell; and the CAR comprises (i) an ADBD that binds to said first AD on the target cell or the Adapter, (ii) a transmembrane domain, and (iii) an intracellular domain. In one embodiment, the patient has been treated with an Adapter comprising (i) a first AD and (ii) an ADBD that binds to a second AD on the target cell; and the CAR comprises (i) an ADBD that binds to said first AD on the Adapter, (ii) a transmembrane domain, and (iii) an intracellular domain. In one embodiment, a first AD is present on the target cell; the patient has been treated with an Adapter comprising (i) an ADBD that binds to the first AD on said target cell and (ii) a second AD; and the CAR comprises (i) an ADBD that is an ASBD that binds to said second AD, (ii) a transmembrane domain, and (iii) an intracellular domain. In one embodiment, a first AD is present on the target cell; the patient has been treated with an Adapter comprising (i) an ADBD comprising an ASBD that binds to the first AD on the target cell and (ii) a second AD; and the CAR comprises (i) an ADBD that binds to said second AD, (ii) a transmembrane domain, and (iii) an intracellular domain. In the methods of killing a target cell in a patient comprising administering a cell expressing a CAR to a patient, the cell expressing a CAR can be any of the cells expressing CARs described herein (e.g., as described in Section VII and Section XI) and/or the patient can have been treated with any of Adapters described herein (e.g., as described in Section V and Section XI). In the methods of killing a target cell in a patient comprising administering a cell expressing a CAR to a patient, the cell expressing a CAR can be in a pharmaceutically acceptable composition. In some embodiments, the CAR cell comprises a genetic modification that reduces or eliminates the expression of an AD bound by the CAR or the Adapter.

In one embodiment, a method of delivering an immune response to a target cell in a patient comprises administering a cell expressing a CAR to the patient. In another embodiment, a method of killing a target cell in a patient comprises administering a cell expressing a CAR to the patient. In another embodiment, a method of depleting lymphocytes in a patient comprises administering a cell expressing a CAR to the patient. In another embodiment, a method of treating a proliferative disorder, cancer, autoimmune disease, infection, or allograft rejection in a patient comprises administering a cell expressing a CAR to the patient. In certain embodiments, a method of treating hematological cancer comprises administering a cell expressing a CAR to the patient. In certain embodiments, a method of treating an autoimmune disease or disorder comprises administering a cell expressing a CAR to the patient. In one embodiment, a first AD and a second AD are present on the target cell, the patient comprises an Adapter comprising (i) said first AD and (ii) an ADBD that binds to the second AD on said target cell; and the CAR comprises (i) an ADBD that binds to said first AD on the target cell or the Adapter, (ii) a transmembrane domain, and (iii) an intracellular domain. In one embodiment, the patient comprises an Adapter comprising (i) a first AD and (ii) an ADBD that binds to a second AD on the target cell; and the CAR comprises (i) an ADBD that binds to said first AD on the Adapter, (ii) a transmembrane domain, and (iii) an intracellular domain. In one embodiment, a first AD is present on the target cell; the patient comprises an Adapter comprising (i) an ADBD that binds to the first AD on said target cell and (ii) a second AD; and the CAR comprises (i) an ADBD that is an ASBD that binds to said second AD, (ii) a transmembrane domain, and (iii) an intracellular domain. In one embodiment, a first AD is present on the target cell; the patient comprises an Adapter comprising (i) an ADBD comprising an ASBD that binds to the first AD on the target cell and (ii) a second AD; and the CAR comprises (i) an ADBD that binds to said second AD, (ii) a transmembrane domain, and (iii) an intracellular domain. In the methods of killing a target cell in a patient comprising administering a cell expressing a CAR to a patient, the cell expressing a CAR can be any of the cells expressing CARs described herein (e.g., as described in Section VII and Section XI) and/or the patient can comprise any of Adapters described herein (e.g., as described in Section V and Section XI). In the methods of killing a target cell in a patient comprising administering a cell expressing a CAR to a patient, the cell expressing a CAR can be in a pharmaceutically acceptable composition. In some embodiments, the CAR cell comprises a genetic modification that reduces or eliminates the expression of an AD bound by the CAR or the Adapter.

In one embodiment, a method of delivering an immune response to a target cell in a patient comprises administering a cell expressing a CAR and an Adapter to the patient. In another embodiment, a method of killing a target cell in a patient comprises administering a cell expressing a CAR and an Adapter to the patient. In another embodiment, a method of depleting lymphocytes in a patient comprises administering a cell expressing a CAR and an Adapter to the patient. In another embodiment, a method of treating a proliferative disorder, cancer, autoimmune disease, infection, or allograft rejection in a patient comprises administering a cell expressing a CAR and an Adapter to the patient. In certain embodiments, a method of treating hematological cancer comprises administering a cell expressing a CAR and an Adapter to the patient. In certain embodiments, a method of treating an autoimmune disease or disorder comprises administering a cell expressing a CAR and an Adapter to the patient. In one embodiment, a first AD and a second AD are present on the target cell, the Adapter comprises (i) said first AD and (ii) an ADBD that binds to the second AD on said target cell; and the CAR comprises (i) an ADBD that binds to said first AD on the target cell or the Adapter, (ii) a transmembrane domain, and (iii) an intracellular domain. In one embodiment, the Adapter comprises (i) a first AD and (ii) an ADBD that binds to a second AD on the target cell; and the CAR comprises (i) an ADBD that binds to said first AD on the Adapter, (ii) a transmembrane domain, and (iii) an intracellular domain. In one embodiment, a first AD is present on the target cell; the Adapter comprises (i) an ADBD that binds to the first AD on said target cell and (ii) a second AD; and the CAR comprises (i) an ADBD that is an ASBD that binds to said second AD, (ii) a transmembrane domain, and (iii) an intracellular domain. In one embodiment, a first AD is present on the target cell; the Adapter comprises (i) an ADBD comprising an ASBD that binds to the first AD on the target cell and (ii) a second AD; and the CAR comprises (i) an ADBD that binds to said second AD, (ii) a transmembrane domain, and (iii) an intracellular domain. In the methods of killing a target cell in a patient comprising administering a cell expressing a CAR and an Adapter to a patient, the cell expressing a CAR can be any of the cells expressing CARs described herein (e.g., as described in Section VII and Section XI) and the Adapter can be any of the Adapters described herein (e.g., as described in Section V and Section XI). In the methods of killing a target cell in a patient comprising administering a cell expressing a CAR and an Adapter to a patient, the cell expressing a CAR and the Adapter can be in a pharmaceutically acceptable composition. In some embodiments, the cell expressing a CAR and the Adapter are in a single pharmaceutically acceptable composition. In some embodiments, the cell expressing a CAR and the Adapter are in separate pharmaceutically acceptable compositions. In some embodiments, the CAR cell comprises a genetic modification that reduces or eliminates the expression of an AD bound by the CAR or the Adapter.

In certain embodiments, the CAR comprises a single-chain variable fragment (scFv) ADBD. In other embodiments, the CAR comprises an alternative scaffold binding domain (ASBD) ADBD. In further embodiments, the CAR comprises a D domain.

In some embodiments, the CAR comprises 2 ADBDs. In other embodiments, the CAR comprises an ASBD and a scFv. In further embodiments, the CAR comprises a D domain and a scFv. In some embodiments, the CAR comprises 2 ASBDs. In further embodiments, the CAR comprises 2 D domains.

In some embodiments, the CAR intracellular domain is a signaling domain. In further embodiments, the CAR intracellular domain comprises a primary signaling domain. In certain embodiments, the CAR intracellular domain comprises a CD3 ζ primary signaling domain. In some embodiments, the CAR intracellular domain further comprises a costimulatory signaling domain. In further embodiments, the costimulatory signaling domain is selected from: CD28, 41BB, CD27, and CD134. In particular embodiments, the CAR intracellular signaling domain comprises a 41BB costimulatory signaling domain.

In some embodiments, the CAR binds to an antigen selected from: CD45, CD26, CD30, CD33, and CD38. In further embodiments, the CAR binds to CD45. In other embodiments, the CAR binds to CD26. In other embodiments, the CAR binds to CD30 In other embodiments, the CAR binds to CD33. In other embodiments, the CAR binds to CD38. In some embodiments, the CAR binds to a CD45 AD.

In some embodiments, the CAR binds to an antigen selected from: CD19, CD22, CD123, BCMA, CS1, HER2, TACI, BAFFR, and PDL1. In further embodiments, the CAR binds to BCMA. In other embodiments, the CAR binds to CS1. In other embodiments, the CAR binds to CD123. In other embodiments, the CAR binds to CD19. In other embodiments, the CAR binds to CD22. In other embodiments, the CAR binds to TACI. In other embodiments, the CAR binds to BAFFR. In other embodiments, the CAR binds to PDL1. In other embodiments, the CAR binds to HER2.

In some embodiments, the CAR comprises 2 ADBDs that bind to separate targets. In further embodiments, the CAR binds to CD19 and CD123. In other embodiments, the CAR binds to BCMA and CS1. In other embodiments, the CAR binds to CD22 and CD123. In other embodiments, the CAR binds to PDL1 and CD123. In some embodiments, the CAR binds to CD45 and second target. In certain embodiments, the CAR comprises a first ASBD that binds to CD19 and a second ASBD that binds to CD123. In other embodiments, the CAR comprises a first D domain that binds to CD19 and a second D domain that binds to CD123. In other embodiments, the CAR comprises a D domain that binds to CD19 and a scFv that binds to CD123. In certain embodiments, the CAR comprises a first ASBD that binds to BCMA and a second ASBD that binds to CS1. In other embodiments, the CAR comprises a first D domain that binds to BCMA and a second D domain that binds to CS1. In other embodiments, the CAR comprises a D domain that binds to CS1 and a scFv that binds to BCMA. In other embodiments, the CAR comprises a first ASBD that binds to CD22 and a second ASBD that binds to CD123. In other embodiments, the CAR comprises a first D domain that binds to CD22 and a second D domain that binds to CD123. In some embodiments, the CAR comprises a first D domain that binds to a CD45 AD and a second D domain that binds to a second AD. In other embodiments, the CAR comprises a D domain that binds to CD22 and a scFv that binds to CD123. In some embodiments, the CAR comprises a first ASBD that binds to PDL1 and a second ASBD that binds to CD123. In some embodiments, the CAR comprises a first D domain that binds to PDL1 and a second D domain that binds to CD123. In some embodiments, the CAR comprises a D domain that binds to PDL1 and a scFv that binds to CD123. In some embodiments, the CAR comprises an ASBD that binds to CD19 and a scFv that binds to CD123.

In some embodiments, the Adapter comprises an AD of a tumor antigen. In further embodiments, the tumor antigen is selected from the group: CD45, CD26, CD30, CD33, and CD38.

In some embodiments, the Adapter comprises an AD of a tumor antigen. In further embodiments, the tumor antigen is selected from the group: BCMA, CD123, CD19, CD22, CS1, HER2, TACI, BAFFR, and PDL1.

In some embodiments, the Adapter comprises an ADBD that is a scFv. In further embodiments, the Adapter comprises an ADBD that is an ASBD. In some embodiments, the Adapter comprises a D domain.

In some embodiments, the Adapter comprises two ADBDs. In further embodiments, the Adapter comprises two ADBDs that (a) are the same, (b) bind to the same antigenic determinant, (c) bind to different ADs of the same antigen, (d) bind to different antigens on the same cell, or (e) bind to different antigens on different cells. In some embodiments, the Adapter comprises two ASBDs. In certain embodiments, the Adapter comprises two D domains. In some embodiments, the Adapter comprises an ADBD that is a scFv and an ADBD that is an ASBD. In other embodiments, the Adapter comprises an ADBD that is a scFv and an ADBD that is a D domain.

In some embodiments, the Adapter comprises an ADBD that binds to a member selected from: CD45, CD26, CD30, CD33, and CD38. In certain embodiments, the Adapter comprises an ADBD binds to CD26. In other embodiments, the Adapter comprises an ADBD that binds to CD30. In some embodiments, the Adapter comprises an ADBD that binds to CD33. In other embodiments, the Adapter comprises an ADBD that binds to CD38. In other embodiments, the Adapter comprises an ADBD that binds to CD45.

In some embodiments, the Adapter comprises an ADBD that binds to a member selected from: BCMA, CD123, CD19, CD22, CS1, HER2, TACI, BAFFR, and PDL1. In certain embodiments, the Adapter comprises an ADBD binds to BCMA. In other embodiments, the Adapter comprises an ADBD that binds to CD123. In some embodiments, the Adapter comprises an ADBD that binds to CD19. In other embodiments, the Adapter comprises an ADBD that binds to CD22. In other embodiments, the Adapter comprises an ADBD that binds to CS1. In other embodiments, the Adapter comprises an ADBD that binds to TACI. In other embodiments, the Adapter comprises an ADBD that binds to BAFFR. In other embodiments, the Adapter comprises an ADBD that binds to PDL1.

In some embodiments, the Adapter is bispecific. In further embodiments, the Adapter comprises an ADBD that binds to CD19 and an ADBD that binds to CD123. In other embodiments, the Adapter comprises an ADBD that binds to BCMA and an ADBD that binds to CS1. In other embodiments, the Adapter comprises an ADBD that binds to CD22 and an ADBD that binds to CD123. In other embodiments, the Adapter comprises an ADBD that binds to PDL1 and an ADBD that binds to CD123. In some embodiments, the Adapter comprises an ADBD that binds to a CD45 AD and an ADBD that binds to a second AD.

In some embodiments, the target cell is a tumor cell. In further embodiments, the tumor cell is selected from the group: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In further embodiments, the tumor cell is selected from the group: acute myeloid leukemia (AML), chronic lymphocytic leukemia (CLL), and multiple myeloma (MM). In some embodiments, the tumor cell is an AML tumor cell. In some embodiments, the tumor cell is a CLL tumor cell. In some embodiments, the tumor cell is an MM tumor cell.

In some embodiments, the target cell is a cancer cell. In further embodiments, the cancer cell is selected from the group: breast cancer, prostate cancer, ovarian cancer, pancreatic cancer, colon cancer, and lung cancer. In further embodiments, the cancer cell is breast cancer. In some embodiments, the cancer cell is ovarian cancer.

In some embodiments, the composition comprises at least two target cells. In some embodiments, at least one target cell is a tumor cell. In further embodiments, the first and second target cells are tumor cells. In certain embodiments, the first and second tumor cells are of the same tumor type. In other embodiments, the first and second tumor cells are of a different tumor type. In some embodiments, the tumor cells are selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia. In some embodiments, the tumor cells are selected from: acute myeloid leukemia (AML), chronic lymphocytic leukemia (CLL), and multiple myeloma (MM). In some embodiments, the tumor cells are multiple myeloma (MM).

In some embodiments, the cell expressing the CAR is an immune effector cell. In further embodiments, the immune effector cell is a T cell. In other embodiments, the immune effector cell is an NK cell. In some embodiments, the cell expressing the CAR kills the target cell. In some embodiments, binding of the Adapter to an AD blocks the activity of the antigen comprising the AD.

In embodiments, a method of killing a target cell in a patient comprises administering an Adapter and a cell expressing a CAR to the patient. The Adapter and the cell expressing the CAR can be administered in the same pharmaceutical composition or in different pharmaceutical compositions. The Adapter and the cell expressing the CAR can be administered in different pharmaceutical compositions. The Adapter and the cell expressing the CAR can be administered simultaneously or consecutively.

In one embodiment of the methods of killing a target cell in a patient or the methods of redirecting target cell killing in a patient, the patient has been diagnosed with cancer and the target cell is a cancer cell. In one embodiment, the cancer cell is a prostate cancer cell, a breast cancer cell, a colorectal cancer cell, a lung cancer cell, an osteosarcoma cell, or a glioblastoma cell. Thus, in some embodiments, the methods provided herein treat cancer.

Cancers that can be treated include tumors that are not vascularized, or not yet substantially vascularized, as well as vascularized tumors. The cancers can comprise non-solid tumors (such as hematological tumors, for example, leukemias and lymphomas) or can comprise solid tumors. Types of cancers to be treated include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pineaioma, hemangioblastoma, acoustic neuroma, oligodendroglioma, menangioma, neuroblastoma, retinoblastoma and brain metastases). In some embodiments, the solid tumor is breast cancer. In some embodiments, the solid tumor is ovarian cancer.

In another embodiment, the methods described herein are useful for treating a patient having a hematological cancer. Examples of hematological (or hematogenous) cancers include leukemias, including acute leukemias (such as acute lymphocytic leukemia, acute myelocytic leukemia, acute myelogenous leukemia and myeloblasts, promyeiocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. Further examples of hematological (or hematogenous) cancers include acute myeloid leukemia (AML), chronic lymphocytic leukemia (CLL), and multiple myeloma (MM). In some embodiments, the hematological (or hematogenous) cancer is AML. In some embodiments, the hematological (or hematogenous) cancer is CLL. In some embodiments, the hematological (or hematogenous) cancer is MM.

In some embodiments, the cancer is a relapsed of refractory cancer. In some embodiments, the cancer is a relapsed cancer. In some embodiments, the cancer has relapsed following chemotherapy. In some embodiments, the cancer has relapsed following treatment with a biological agent. In some embodiments, the biological agent is a therapeutic antibody or a CAR-T cell. In some embodiments, the cancer is a refractory cancer. In some embodiments, the cancer is refractory to chemotherapy. In some embodiments, the cancer is refractory to treatment with a biological agent. In some embodiments, the biological agent is a therapeutic antibody or a CAR-T cell.

In some embodiments, the cancer is a relapsed of refractory hematological cancer. In some embodiments, the cancer is a relapsed hematological cancer. In some embodiments, the cancer is a hematological cancer that has relapsed following chemotherapy. In some embodiments, the cancer is a hematological cancer that has relapsed following treatment with a biological agent. In some embodiments, the biological agent is a therapeutic antibody or a CAR-T cell. In some embodiments, the cancer is a hematological cancer that has relapsed following autologous bone marrow transplantation. In some embodiments, the cancer is a hematological cancer that has relapsed following allogeneic bone marrow transplantation. In some embodiments, the cancer is a hematological cancer that has relapsed following hematopoietic stem cell transplantation (HSCT). In some embodiments, the HSCT is autologous HSCT. In some embodiments, the cancer is a refractory hematological cancer. In some embodiments, the cancer is a hematological cancer that is refractory to chemotherapy. In some embodiments, the cancer is a hematological cancer that is refractory to treatment with a biological agent. In some embodiments, the biological agent is a therapeutic antibody or a CAR-T cell. In some embodiments, the hematological cancer is acute myeloid leukemia (AML), chronic lymphocytic leukemia (CLL), or multiple myeloma (MM). In some embodiments, the hematological cancer is AML. In some embodiments, the hematological cancer is CLL. In some embodiments, the hematological cancer is MM. In some embodiments, the target cell is a B cell. In some embodiments, the target cell is a T cell. In some embodiments, the target cell is a naïve T cell. In some embodiments, the target cell is a memory T cell. In some embodiments, the target cell is a myeloma cell In one embodiment, a method of delivering an immune response to a multiple myeloma cell in a patient comprises administering an Adapter to the patient. In another embodiment, a method of killing a multiple myeloma cell in a patient comprises administering an Adapter to the patient. In another embodiment, a method of depleting multiple myeloma cells in a patient comprises administering an Adapter to the patient. In another embodiment, a method of treating multiple myeloma in a patient comprises administering an Adapter to the patient. In one embodiment, the patient has been treated with a cell expressing a chimeric antigen receptor (CAR), wherein the CAR comprises (i) an antigenic determinant binding domain (ADBD) that binds to a first antigenic determinant (AD) on said multiple myeloma cell (e.g., CS1 or BCMA), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient has been treated with a cell expressing a chimeric antigen receptor (CAR), wherein the CAR comprises (i) an antigenic determinant binding domain (ADBD) that is an ASBD that binds to a first antigenic determinant (AD) (e.g., AFP p26 or a variant thereof), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient has been treated with a cell expressing a chimeric antigen receptor (CAR), wherein the CAR comprises (i) an antigenic determinant binding domain (ADBD) that binds to a first antigenic determinant (AD) (e.g., AFP p26 or a variant thereof), (ii) a transmembrane domain, and (iii) an intracellular domain; and the Adapter comprises (i) said first AD and (ii) an ADBD that is an ASBD that binds to a second AD on said multiple myeloma cell (e.g., CS1 or BCMA). In the methods of killing a multiple myeloma cell in a patient comprising administering an Adapter to a patient, the Adapter can be any of the Adapters described herein (e.g., as described in Section V and Section XI) and/or the patient can have been treated with any of the cells expressing CARS described herein (e.g., as described in Section VII and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In some embodiments of the methods of killing a multiple myeloma cell in a patient comprising administering an Adapter to a patient, the patient has previously been treated with an Adapter (in addition to the cell expressing a CAR). In some embodiments, the Adapter that is administered to the patient and the Adapter that was previously administered to the patient bind to different ADs (e.g., on the same or different multiple myeloma cells). In some embodiments, the Adapter that is administered to the patient binds to CS1 and the Adapter that was previously administered to the patient binds to BCMA. In some embodiments, the Adapter that is administered to the patient binds to BCMA and the Adapter that was previously administered to the patient binds to CS1. In the methods of killing a multiple myeloma cell in a patient comprising administering an Adapter to a patient, the Adapter can be in a pharmaceutically acceptable composition. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, a method of delivering an immune response to a multiple myeloma cell in a patient comprises administering an Adapter to the patient. In another embodiment, a method of killing a multiple myeloma cell in a patient comprises administering an Adapter to the patient. In another embodiment, a method of depleting multiple myeloma cells in a patient comprises administering an Adapter to the patient. In another embodiment, a method of treating multiple myeloma in a patient comprises administering an Adapter to the patient. In one embodiment, the patient comprises a cell expressing a chimeric antigen receptor (CAR), wherein the CAR comprises (i) an antigenic determinant binding domain (ADBD) that binds to a first antigenic determinant (AD) on said multiple myeloma cell (e.g., CS1 or BCMA), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient comprises a cell expressing a chimeric antigen receptor (CAR), wherein the CAR comprises (i) an antigenic determinant binding domain (ADBD) that is an ASBD that binds to a first antigenic determinant (AD) (e.g., AFP p26 or a variant thereof), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient comprises a cell expressing a chimeric antigen receptor (CAR), wherein the CAR comprises (i) an antigenic determinant binding domain (ADBD) that binds to a first antigenic determinant (AD) (e.g., AFP p26 or a variant thereof), (ii) a transmembrane domain, and (iii) an intracellular domain; and the Adapter comprises (i) said first AD and (ii) an ADBD that is an ASBD that binds to a second AD on said multiple myeloma cell (e.g., CS1 or BCMA). In the methods of killing a multiple myeloma cell in a patient comprising administering an Adapter to a patient, the Adapter can be any of the Adapters described herein (e.g., as described in Section V and Section XI) and/or the patient can comprise any of the cells expressing CARS described herein (e.g., as described in Section VII and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In some embodiments of the methods of killing a multiple myeloma cell in a patient comprising administering an Adapter to a patient, the patient comprises an Adapter (in addition to the cell expressing a CAR). In some embodiments, the Adapter that is administered to the patient and the Adapter comprised by the patient bind to different ADs (e.g., on the same or different multiple myeloma cells). In some embodiments, the Adapter that is administered to the patient binds to CS1 and the Adapter comprised by the patient binds to BCMA. In some embodiments, the Adapter that is administered to the patient binds to BCMA and the Adapter comprised by the patient binds to CS1. In the methods of killing a multiple myeloma cell in a patient comprising administering an Adapter to a patient, the Adapter can be in a pharmaceutically acceptable composition. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, a method of redirecting an immune response to a multiple myeloma cell in a patient comprises administering an Adapter to the patient. In another embodiment, a method of redirecting multiple myeloma cell killing in a patient comprises administering an Adapter to the patient. In another embodiment, a method of redirecting lymphocyte depletion in a patient comprises administering an Adapter to the patient. In another embodiment, a method of redirecting treatment of multiple myeloma comprises administering an Adapter to the patient. In certain embodiments, a method of redirecting treatment of an autoimmune disease or disorder comprises administering an Adapter to the patient. In one embodiment, the patient has been treated with a cell expressing a chimeric antigen receptor (CAR), wherein the CAR comprises (i) an antigenic determinant binding domain (ADBD) that binds to a first antigenic determinant (AD) on said multiple myeloma cell (e.g., CS1 or BCMA), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient has been treated with a cell expressing a chimeric antigen receptor (CAR), wherein the CAR comprises (i) an antigenic determinant binding domain (ADBD) that is an ASBD that binds to a first antigenic determinant (AD) (e.g., AFP p26 or a variant thereof), (ii) a transmembrane domain, and (iii) an intracellular domain; and the Adapter comprises (i) said first AD and (ii) an ADBD that binds to a second AD on said multiple myeloma cell (e.g., CS1 or BCMA). In one embodiment, the patient has been treated with a cell expressing a chimeric antigen receptor (CAR), wherein the CAR comprises (i) an antigenic determinant binding domain (ADBD) that binds to a first antigenic determinant (AD) (e.g., AFP p26 or a variant thereof), (ii) a transmembrane domain, and (iii) an intracellular domain; and the Adapter comprises (i) said first AD and (ii) an ADBD that is an ASBD that binds to a second AD on said multiple myeloma cell (e.g., CS1 or BCMA). In the methods of killing a multiple myeloma cell in a patient comprising administering an Adapter to a patient, the Adapter can be any of the Adapters described herein (e.g., as described in Section V and Section XI) and/or the patient can have been treated with any of the cells expressing CARS described herein (e.g., as described in Section VII and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In some embodiments of the methods of killing a multiple myeloma cell in a patient comprising administering an Adapter to a patient, the patient has previously been treated with an Adapter (in addition to the cell expressing a CAR). In some embodiments, the Adapter that is administered to the patient and the Adapter that was previously administered to the patient bind to different ADs (e.g., on the same or different multiple myeloma cells). In some embodiments, the Adapter that is administered to the patient binds to CS1 and the Adapter that was previously administered to the patient binds to BCMA. In some embodiments, the Adapter that is administered to the patient binds to BCMA and the Adapter that was previously administered to the patient binds to CS1. In the methods of redirecting multiple myeloma cell killing in a patient comprising administering an Adapter to a patient, the Adapter can be in a pharmaceutically acceptable composition. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, a method of delivering an immune response to a multiple myeloma cell in a patient comprises administering a cell expressing a CAR to the patient. In another embodiment, a method of killing a multiple myeloma cell in a patient comprises administering a cell expressing a CAR to the patient. In another embodiment, a method of depleting multiple myeloma cells in a patient comprises administering a cell expressing a CAR to the patient. In another embodiment, a method of treating multiple myeloma in a patient comprises administering a cell expressing a CAR to the patient. In one embodiment, a first AD (e.g., BCMA) and a second AD (e.g., CS1) are present on the multiple myeloma cell, the patient has been treated with an Adapter comprising (i) said first AD and (ii) an ADBD that binds to the second AD on said multiple myeloma cell; and the CAR comprises (i) an ADBD that binds to said first AD on the multiple myeloma cell or the Adapter, (ii) a transmembrane domain, and (iii) an intracellular domain. In one embodiment, the patient has been treated with an Adapter comprising (i) a first AD (e.g., BCMA) and (ii) an ADBD that binds to a second AD on the multiple myeloma cell (e.g., CS1); and the CAR comprises (i) an ADBD that binds to said first AD on the Adapter, (ii) a transmembrane domain, and (iii) an intracellular domain. In one embodiment, a first AD is present on the multiple myeloma cell (e.g., CS1); the patient has been treated with an Adapter comprising (i) an ADBD that binds to the first AD on said multiple myeloma cell and (ii) a second AD (e.g., BCMA); and the CAR comprises (i) an ADBD that is an ASBD that binds to said second AD, (ii) a transmembrane domain, and (iii) an intracellular domain. In one embodiment, a first AD is present on the multiple myeloma cell (e.g., CS1); the patient has been treated with an Adapter comprising (i) an ADBD comprising an ASBD that binds to the first AD on the multiple myeloma cell and (ii) a second AD (e.g., BCMA); and the CAR comprises (i) an ADBD that binds to said second AD, (ii) a transmembrane domain, and (iii) an intracellular domain. In the methods of killing a multiple myeloma cell in a patient comprising administering a cell expressing a CAR to a patient, the cell expressing a CAR can be any of the cells expressing CARs described herein (e.g., as described in Section VII and Section XI) and/or the patient can have been treated with any of Adapters described herein (e.g., as described in Section V and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In the methods of killing a multiple myeloma cell in a patient comprising administering a cell expressing a CAR to a patient, the cell expressing a CAR can be in a pharmaceutically acceptable composition. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, a method of delivering an immune response to a multiple myeloma cell in a patient comprises administering a cell expressing a CAR to the patient. In another embodiment, a method of killing a multiple myeloma cell in a patient comprises administering a cell expressing a CAR to the patient. In another embodiment, a method of treating multiple myeloma in a patient comprises administering a cell expressing a CAR to the patient. In one embodiment, a first AD (e.g., BCMA) and a second AD (e.g., CS1) are present on the multiple myeloma cell, the patient comprises an Adapter comprising (i) said first AD and (ii) an ADBD that binds to the second AD on said multiple myeloma cell; and the CAR comprises (i) an ADBD that binds to said first AD on the multiple myeloma cell or the Adapter, (ii) a transmembrane domain, and (iii) an intracellular domain. In one embodiment, the patient comprises an Adapter comprising (i) a first AD (e.g., BCMA) and (ii) an ADBD that binds to a second AD (e.g., CS1) on the multiple myeloma cell; and the CAR comprises (i) an ADBD that binds to said first AD on the Adapter, (ii) a transmembrane domain, and (iii) an intracellular domain. In one embodiment, a first AD is present on the multiple myeloma cell (e.g., CS1); the patient comprises an Adapter comprising (i) an ADBD that binds to the first AD on said multiple myeloma cell and (ii) a second AD (e.g., BCMA); and the CAR comprises (i) an ADBD that is an ASBD that binds to said second AD, (ii) a transmembrane domain, and (iii) an intracellular domain. In one embodiment, a first AD is present on the multiple myeloma cell (e.g., CS1); the patient comprises an Adapter comprising (i) an ADBD comprising an ASBD that binds to the first AD on the multiple myeloma cell and (ii) a second AD (e.g., BCMA or AFP p26 or a variant thereof); and the CAR comprises (i) an ADBD that binds to said second AD, (ii) a transmembrane domain, and (iii) an intracellular domain. In the methods of killing a multiple myeloma cell in a patient comprising administering a cell expressing a CAR to a patient, the cell expressing a CAR can be any of the cells expressing CARs described herein (e.g., as described in Section VII and Section XI) and/or the patient can comprise any of Adapters described herein (e.g., as described in Section V and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In the methods of killing a multiple myeloma cell in a patient comprising administering a cell expressing a CAR to a patient, the cell expressing a CAR can be in a pharmaceutically acceptable composition. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, a method of delivering an immune response to a multiple myeloma cell in a patient comprises administering a cell expressing a CAR and an Adapter to the patient. In another embodiment, a method of killing a multiple myeloma cell in a patient comprises administering a cell expressing a CAR and an Adapter to the patient. In another embodiment, a method of depleting multiple myeloma cells in a patient comprises administering a cell expressing a CAR and an Adapter to the patient. In another embodiment, a method of treating multiple myeloma in a patient comprises administering a cell expressing a CAR and an Adapter to the patient. In one embodiment, a first AD (e.g., BCMA) and a second AD (e.g., CS1) are present on the multiple myeloma cell, the Adapter comprises (i) said first AD and (ii) an ADBD that binds to the second AD on said multiple myeloma cell; and the CAR comprises (i) an ADBD that binds to said first AD on the multiple myeloma cell or the Adapter, (ii) a transmembrane domain, and (iii) an intracellular domain. In one embodiment, the Adapter comprises (i) a first AD (e.g., BCMA) and (ii) an ADBD that binds to a second AD on the multiple myeloma cell (e.g., CS1); and the CAR comprises (i) an ADBD that binds to said first AD on the Adapter, (ii) a transmembrane domain, and (iii) an intracellular domain. In one embodiment, a first AD (e.g., CS1) is present on the multiple myeloma cell; the Adapter comprises (i) an ADBD that binds to the first AD on said multiple myeloma cell and (ii) a second AD (e.g., BCMA); and the CAR comprises (i) an ADBD that is an ASBD that binds to said second AD, (ii) a transmembrane domain, and (iii) an intracellular domain. In one embodiment, a first AD is present on the multiple myeloma cell (e.g., CS1); the Adapter comprises (i) an ADBD comprising an ASBD that binds to the first AD on the multiple myeloma cell and (ii) a second AD (e.g., BCMA or AFP p26 or a variant thereof); and the CAR comprises (i) an ADBD that binds to said second AD, (ii) a transmembrane domain, and (iii) an intracellular domain. In the methods of killing a multiple myeloma cell in a patient comprising administering a cell expressing a CAR and an Adapter to a patient, the cell expressing a CAR can be any of the cells expressing CARs described herein (e.g., as described in Section VII and Section XI) and the Adapter can be any of the Adapters described herein (e.g., as described in Section V and Section XI). In some embodiments, the Adapter comprises an ADBD (e.g., D domain) that binds to CS1, BCMA, or CS1 and BCMA. In some embodiments, the CAR comprises an ADBD (e.g., D domain) that binds to CS1, BCMA, or CS1 and BCMA. In some embodiments, the CAR comprises an ADBD (e.g., D domain) that binds to AFP p26 or a variant thereof. In the methods of killing a multiple myeloma cell in a patient comprising administering a cell expressing a CAR and an Adapter to a patient, the cell expressing a CAR and the Adapter can be in a pharmaceutically acceptable composition. In some embodiments, the cell expressing a CAR and the Adapter are in a single pharmaceutically acceptable composition. In some embodiments, the cell expressing a CAR and the Adapter are in separate pharmaceutically acceptable compositions. In some embodiments, the patient has relapsed multiple myeloma. In some embodiments, the patient has multiple myeloma that relapsed following treatment with a biologic agent, for example, antibody or CAR-T cell. In some embodiments, he patient has multiple myeloma that relapsed following treatment with antibody or CAR-T cell that targeted CS1 or BCMA.

In one embodiment, the methods described herein are useful for inhibiting tumor growth, reducing neovascularization, reducing angiogenesis, inducing differentiation, reducing tumor volume, and/or reducing the tumorigenicity of a tumor.

In one embodiment of the methods of killing a target cell in a patient or the methods of redirecting target cell killing in a patient, the patient has been diagnosed with a disease or disorder of the immune system and the target cell is a cell of the immune system. Thus in some embodiments, the methods provided herein treat a disease or disorder of the immune system.

In some embodiments, the disease or disorder of the immune system is an autoimmune disease or disorder. In some embodiments, the autoimmune disease or disorder is Type I diabetes, systemic sclerosis, multiple sclerosis, rheumatoid arthritis, juvenile idiopathic arthritis, psoriasis, inflammatory bowel disease (IBD), Crohn's disease, ulcerative colitis, or alopecia areata. In some embodiments, the autoimmune disease or disorder is Type I diabetes. In some embodiments, the autoimmune disease or disorder is systemic sclerosis. In some embodiments, the autoimmune disease or disorder is multiple sclerosis. In some embodiments, the autoimmune disease or disorder is rheumatoid arthritis. In some embodiments, the autoimmune disease or disorder is inflammatory bowel disease (IBD). In some embodiments, the autoimmune disease or disorder is Crohn's disease. In some embodiments, the autoimmune disease or disorder is ulcerative colitis.

In one embodiment of the methods of killing, a target cell in a patient or the methods of redirecting target cell killing in a patient, the target cell is a cell of the immune system. In some embodiments, the target cell is a B cell. In some embodiments, the target cell is a T cell. In some embodiments, the target cell is a naïve T cell. In some embodiments, the target cell is a memory T cell.

In one embodiment of the methods of killing, a target cell in a patient or the methods of redirecting target cell killing in a patient, the patient has been diagnosed with an autoimmune disease or disorder and the target cell is a cell of the immune system expressing a CD45 AD. In some embodiments, the target cell is a B cell. In some embodiments, the target cell is a T cell. In some embodiments, the target cell is a memory T cell. In some embodiments, the target cell expresses CD45. In some embodiments, the target cell expresses CD45RO.

In one embodiment of the methods of killing a target cell in a patient or the methods of redirecting target cell killing in a patient, the patient has an infection, and the target cell is a bacterial cell (e.g., tuberculosis, smallpox, and anthrax), a cell of a parasite (e.g., malaria or leishmaniosis) a fungal cell, a mold, a *Mycoplasma*, or a cell infected with a virus (e.g., HIV, hepatitis b, rabies, Nipah virus, west Nile virus, a meningitis virus, or CMV). Thus in some embodiments, the methods provided herein treat an infection.

In one embodiment, the methods described herein are useful for preparing or conditioning a patient for bone marrow transplantation (BMT) or hematopoietic stem cell transplantation (HSCT). Thus in some embodiments, the methods of killing a target cell in a patient or the methods of redirecting target cell killing in a patient provided herein condition a subject for BMT or HSCT. In some embodiments, the methods provided herein condition a subject for HSCT. In some embodiments, the HSCT is autologous HSCT. In some embodiments, the methods for conditioning a patient disclosed herein does not comprise high dose chemotherapy or total body irradiation (TBI). In some embodiments, the methods for conditioning disclosed herein comprise reduced intensity chemotherapy. In some embodiments, the methods for conditioning disclosed herein comprise total body irradiation. In some embodiments, the patient is more than 65 years old. In some embodiments, the patient has cancer. In some embodiments, the patient has a hematologic cancer. In some embodiments, the patient has a relapsed hematologic cancer. In some embodiments, the hematologic cancer is acute myeloid leukemia (AML), chronic lymphocytic leukemia (CLL), or multiple myeloma (MM). In some embodiments, the patient has an autoimmune disease or disorder. In some embodiments, the autoimmune disease or disorder is Type I diabetes, multiple sclerosis, rheumatoid arthritis, inflammatory bowel disease (IBD), Crohn's disease, or ulcerative.

In several embodiments, the administration of the Adapter and/or chimeric antigen receptor cells is intravenous, though other routes, such as intra-arterial, intramuscular, local, or other acceptable route can be used for a given treatment scenario.

Also provided are therapeutic compositions useful for practicing therapeutic methods described herein. In one embodiment, therapeutic compositions provided herein contain a physiologically tolerable carrier together with at least one species of Adapter as described herein, dissolved or dispersed therein as an active ingredient. In another embodiment, therapeutic compositions provided herein contain a physiologically tolerable carrier together with at least one species of a CAR cell as described herein, dissolved or dispersed therein as an active ingredient. In a preferred embodiment, therapeutic composition is not immunogenic when administered to a human patient for therapeutic purposes.

The preparation of a pharmacological composition that contains active ingredients dissolved or dispersed therein is well understood in the art. Typically such compositions are prepared as sterile injectables either as liquid solutions or suspensions, aqueous or non-aqueous. However, solid forms suitable for solution, or suspensions, in liquid prior to use can also be prepared. The preparation can also be emulsified. Thus, an Adapter-containing composition can take the form of solutions, suspensions, tablets, capsules, sustained release formulations or powders, or other compositional forms. In some embodiments, the Adapter compositions are formulated to ensure or optimize distribution in vivo, For example, the blood-brain barrier (BBB) excludes many highly hydrophilic compounds and if so desired, the compositions are prepared so as to increase transfer across the BBB, by for example, formulation in liposomes. For methods of manufacturing liposomes, see, e.g., U.S. Pat. Nos. 4,522,811, 5,374,548, and 5,399,331. The liposomes can comprise one or more moieties that are selectively transported into specific cells or organs, thus enhance targeted drug delivery (see, e.g., Ranade, Clin. Pharmacol. 29: 685 (1989)).

The Adapter (and/or CAR cell) can be mixed other active ingredients and/or excipients that are pharmaceutically acceptable and compatible with the active ingredient and in amounts suitable for use in therapeutic methods described herein. Suitable excipients are, for example, water, saline, dextrose, glycerol, ethanol or the like and combinations thereof. In addition, if desired, the composition can contain minor amounts of auxiliary substances such as wetting or emulsifying agents, pH buffering agents and other auxiliary substances known in the art, which enhance the effectiveness of the active ingredient.

Therapeutic Adapter formulations can include pharmaceutically acceptable salts of the components therein. Pharmaceutically acceptable salts include the acid addition salts (formed with the free amino groups of the polypeptide) that are formed with inorganic acids such as, for example, hydrochloric or phosphoric acids, or such organic acids as acetic, tartaric, mandelic and other pharmaceutically acceptable salts known in the art. Salts formed with the free carboxyl groups can also be derived from inorganic bases such as, for example, sodium, potassium, ammonium, calcium or ferric hydroxides, and such organic bases as isopropylamine, trimethylarsine, 2-ethylamino ethanol, histidine, procaine and other salts derived from inorganic bases known in the art.

Physiologically tolerable carriers are known in the art. Exemplary of liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, propylene glycol, polyethylene glycol, and other solutes.

Liquid compositions can also contain liquid phases in addition to, and to the exclusion of water. Exemplary of such additional liquid phases are glycerin, vegetable oils such as cottonseed oil, organic esters such as ethyl oleate, and water-oil emulsions.

In one embodiment, a therapeutic composition contains an Adapter, typically in an amount of at least 0.1 weight percent of Adapter per weight of total therapeutic composition. A weight percent is a ratio by weight of Adapter per total composition. Thus, for example, 0.1 weight percent is 0.1 grams of Adapter per 100 grams of total composition.

Adapter-containing therapeutic compositions typically contains about 10 micrograms (µg) per milliliter (ml) to about 100 milligrams (mg) per ml of Adapter as active ingredient per volume of composition, and more preferably contains about 1 mg/ml to about 10 mg/ml (i.e., about 0.1 to 1 weight percent).

The dosage ranges for the administration of the Adapter are those large enough to produce the desired effect in which the disease symptoms mediated by the target molecule are ameliorated. The dosage should not be so large as to cause adverse side effects, such as, hyperviscosity syndromes, pulmonary edema, congestive heart failure, and other adverse side effects known in the art. Generally, the dosage will vary with the age, condition, sex and extent of the disease in the patient and can be determined by one of skill in the art. The dosage can be adjusted by the individual physician in the event of any complication.

The Adapter can be administered parenterally by injection or by gradual infusion over time. Although the target molecule can typically be accessed in the body by systemic administration and therefore most often treated by intravenous administration of therapeutic compositions, other tissues and delivery means are contemplated where there is a likelihood that the tissue targeted contains the target molecule. Thus, Adapter can be administered intravenously, intraperitoneally, intramuscularly, subcutaneously, intracavity, transdermally, and can be delivered by peristaltic means. Adapter can also be delivered by aerosol to airways and lungs.

Therapeutic compositions containing an Adapter can be conventionally administered intravenously, as by injection of a unit dose, for example. The term "unit dose" when used in reference to a therapeutic composition provided herein refers to physically discrete units suitable as unitary dosage for the subject, each unit containing a predetermined quantity of active material calculated to produce the desired therapeutic effect in association with the required diluent; e.g., carrier, or vehicle. In a specific embodiment, therapeutic compositions containing an Adapter are administered subcutaneously.

In some embodiments, the Adapter is administered in a manner compatible with the dosage formulation, and in a therapeutically effective amount. The quantity to be administered depends on the subject to be treated, capacity of the subject's system to utilize the active ingredient, and degree of therapeutic effect desired. Precise amounts of active ingredient required to be administered depend on the judgment of the practitioner and are peculiar to each individual. However, suitable dosage ranges for systemic application are disclosed herein and depend on the route of administration. Suitable regimes for administration are also variable, but are typified by an initial administration followed by repeated doses at one or more hour intervals by a subsequent injection or other administration. Alternatively, continuous intravenous infusion sufficient to maintain concentrations in the blood in the ranges specified for in vivo therapies are contemplated.

The Adapter compositions are formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The dosage ranges for the administration of the Adapter are those large enough to produce the desired effect in which the disease symptoms mediated by the target molecule are ameliorated. The dosage should not be so large as to cause adverse side effects, such as, hyperviscosity syndromes, pulmonary edema, congestive heart failure, and other adverse side effects known in the art. Generally, the dosage will vary with the age, condition, sex and extent of the disease in the patient and can be determined by one of skill in the art. The dosage can be adjusted by the individual physician in the event of any complication.

The dosage schedule and amounts effective for therapeutic and prophylactic uses, i.e., the "dosing regimen," will depend upon a variety of factors, including the cause, stage and severity of the disease or disorder, the health, physical status, age of the mammal being treated, and the site and mode of the delivery of the Adapter. Therapeutic efficacy and toxicity of the complex and formation can be determined by standard pharmaceutical, pharmacological, and toxicological procedures in cell cultures or experimental animals. Data obtained from these procedures can likewise be used in formulating a range of dosages for human use. Moreover, therapeutic index (i.e., the dose therapeutically effective in 50 percent of the population divided by the dose lethal to 50 percent of the population (ED50/LD50)) can readily be determined using known procedures. The dosage is preferably within a range of concentrations that includes the ED50 with little or no toxicity, and may vary within this range depending on the dosage form employed, sensitivity of the patient, and the route of administration.

The dosage regimen also takes into consideration pharmacokinetics parameters known in the art, such as, drug absorption rate, bioavailability, metabolism and clearance (see, e.g., Hidalgo-Aragones, J. Steroid Biochem. Mol. Biol. 58: 611-617 (1996); Groning et al., Pharmazie 51: 337-341 (1996); Fotherby, Contraception 54: 59-69 (1996); and Johnson et al., J. Pharm. Sci. 84: 1144-1146 (1995)). It is well within the state of the art for the clinician to determine the dosage regimen for each subject being treated. Moreover, single or multiple administrations of Adapter compositions can be administered depending on the dosage and frequency as required and tolerated by the subject. The duration of prophylactic and therapeutic treatment will vary depending on the particular disease or condition being treated. Some diseases are amenable to acute treatment whereas others require long-term, chronic therapy. Adapter can be administered serially, or simultaneously with the additional therapeutic agent.

In some embodiments, the Adapter is administered at about 1 mg/kg to about 50 mg/kg, about 1 mg/kg to about 25 mg/kg, about 1 mg/kg to about 20 mg/kg, about 1 mg/kg to about 15 mg/kg, about 1 mg/kg to about 10 mg/kg, or about 1 mg/kg to about 5 mg/kg.

In another embodiment, an Adapter is administered in combination with more one or more additional therapeutics.

A therapeutically effective amount of an Adapter, such as an Adapter fusion protein, can be an amount such that when administered in a physiologically tolerable composition is sufficient to achieve a plasma concentration of from about 0.1 microgram (µg) per milliliter (ml) to about 100 µg/ml, preferably from about 1 µg/ml to about 5 µg/ml, and usually about 5 µg/ml. Stated differently, the dosage can vary from about 0.1 mg/kg to about 300 mg/kg, preferably from about 0.2 mg/kg to about 200 mg/kg, most preferably from about 0.5 mg/kg to about 20 mg/kg, in one or more dose administrations daily, for one or several days.

In one embodiment the disease or disorder is a disease or disorder of the immune system, such as inflammation or an autoimmune disease.

The cells expressing a CAR provided herein can be administered either alone, or as a pharmaceutical composition in combination with diluents and/or with other components such as chemotherapeutics, antibodies, cytokines or cell populations. Compositions provided herein are preferably formulated for intravenous administration that can be administered one or more times.

The CAR-modified T cells can also serve as a type of vaccine for ex vivo immunization and/or in vivo therapy in a mammal. Preferably, the mammal is a human.

Cancers that can be treated with the Adapter or CAR cells include tumors that are not vascularized, or not yet substantially vascularized, as well as vascularized tumors. The cancers can comprise non-solid tumors (such as hematological tumors, for example, leukemias and lymphomas) or can comprise solid tumors. Types of cancers to be treated with the Adapter include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pineaioma, hemangioblastoma, acoustic neuroma, oligodendroglioma, menangioma, neuroblastoma, retinoblastoma and brain metastases). In some embodiments, the solid tumor is breast cancer. In some embodiments, the solid tumor is ovarian cancer.

In another embodiment, the Adapters and/or CAR cells described herein are useful for treating a patient having hematological cancers. Examples of hematological (or hematogenous) cancers include leukemias, including acute leukemias (such as acute lymphocytic leukemia, acute myelocytic leukemia, acute myelogenous leukemia and myeloblasts, promyeiocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. Further examples of hematological (or hematogenous) cancers include acute myeloid leukemia (AML), chronic lymphocytic leukemia (CLL), and multiple myeloma (MM). In some embodiments, the hematological (or hematogenous) cancer is AML. In some embodiments, the hematological (or hematogenous) cancer is CLL. In some embodiments, the hematological (or hematogenous) cancer is MM.

In one embodiment, the antigenic determinant binding domain portion of the Adapter and/or CAR is designed to treat a particular cancer. Cancers that can be treated include tumors that are not vascularized, or not yet substantially vascularized, as well as vascularized tumors. The cancers can comprise non-solid tumors (such as hematological tumors, for example, leukemias and lymphomas) or can comprise solid tumors. Types of cancers to be treated with the CARs include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

Examples of hematological (or hematogenous) cancers include leukemias, including acute leukemias (such as acute lymphocytic leukemia, acute myelocytic leukemia, acute myelogenous leukemia and myeloblasts, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. Further examples of hematological (or hematogenous) cancers include acute myeloid leukemia (AML), chronic lymphocytic leukemia (CLL), and multiple myeloma (MM). In some embodiments, the hematological (or hematogenous) cancer is AML. In some embodiments, the hematological (or hematogenous) cancer is CLL. In some embodiments, the hematological (or hematogenous) cancer is MM.

Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pineaioma, hemangioblastoma, acoustic neuroma, oligodendroglioma, menangioma, neuroblastoma, retinoblastoma and brain metastases).

In one embodiment, cancers and disorders can be treated using the Adapters or CAR cells that target CD19, CD20, CD22, and ROR1. In one specific embodiment, the CAR, Adapter and/or CAR/Adapter combination targets CD22 and is used to treat B-cell lymphoma. In another embodiment the CAR, Adapter and/or CAR/Adapter combination targets CD19 and is used to treat cancers and disorders including but are not limited to pre-B ALL (pediatric indication), adult ALL, mantle cell lymphoma, diffuse large B-cell lymphoma, and salvage post allogenic bone marrow transplantation. In another embodiment the CAR, Adapter and/or CAR/Adapter combination targets CS1 and is used to treat multiple myeloma. In another embodiment the CAR, Adapter and/or CAR/Adapter combination targets BCMA and is used to treat multiple myeloma. In another embodiment the CAR, Adapter and/or CAR/Adapter combination targets CS1 and BCMA, and is used to treat multiple myeloma.

"B-cell associated diseases" as used herein include B-cell immunodeficiencies, autoimmune diseases and/or excessive/uncontrolled cell proliferation associated with B-cells (including lymphomas and/or leukemias). Examples of such diseases, wherein the CARs, Adapters and/or CAR/Adapter combinations provided herein may be used for therapeutic approaches include but are not limited to: systemic lupus erythematosus (SLE), diabetes, rheumatoid arthritis (RA), reactive arthritis, multiple sclerosis (MS), pemphigus vulgaris, celiac disease, Crohn's disease, inflammatory bowel disease, ulcerative colitis, autoimmune thyroid disease, X-linked agammaglobulinaemis, pre-B acute lymphoblastic leukemia, systemic lupus erythematosus, common variable immunodeficiency, chronic lymphocytic leukemia, diseases associated with selective IgA deficiency and/or IgG subclass deficiency, B lineage lymphomas (Hodgkin's lymphoma and/or non-Hodgkin's lymphoma), immunodeficiency with thymoma, transient hypogammaglobulinemia and/or hyper IgM syndrome, as well as virally-mediated B-cell diseases such as EBV mediated lymphoproliferative disease, and chronic infections in which B-cells participate in the pathophysiology.

In one embodiment, the CAR, Adapter and/or CAR/Adapter combination is designed to target mesothelin to treat mesothelioma, pancreatic cancer, ovarian cancer, and other mesothelin-expressing cancers known in the art. In one embodiment, the CAR, Adapter and/or CAR/Adapter combination is designed to target CD33/IL3Ra to treat acute myelogenous leukemia and other CD33/IL3Ra-expressing cancers known in the art. In one embodiment, the CAR, Adapter and/or CAR/Adapter combination is designed to target c-Met to treat triple negative breast cancer, non-small cell lung cancer, and other c-Met expressing cancers known in the art. In one embodiment, the CAR, Adapter and/or CAR/Adapter combination is designed to target PSMA to treat prostate cancer and other PSMA-expressing cancers known in the art. In one embodiment, the CAR, Adapter and/or CAR/Adapter combination is designed to target Glycolipid F77 to treat prostate cancer and other Glycolipid F77-expressing cancers known in the art. In one embodiment, the CAR, Adapter and/or CAR/Adapter combination is designed to target EGFRvIII to treat glioblastoma and other EGFRvIII-expressing cancers known in the art. In one embodiment, the CAR, Adapter and/or CAR/Adapter combination is designed to target GD2 to treat neuroblastoma, melanoma, and other GD2 expressing cancers known in the art. In one embodiment, the CAR, Adapter and/or CAR/Adapter combination is designed to target NY-ESO-1 to treat myeloma, sarcoma, melanoma, and other NY-ESO-1-expressing cancers known in the art. In one embodiment, CAR, Adapter and/or CAR/Adapter combination is can be designed to target MAGEA3 to treat myeloma, sarcoma, melanoma, and other MAGEA3-expressing cancers known in the art. However, the invention should not be construed to be limited to solely to the antigen targets and diseases disclosed herein. Rather, the invention should be construed to include any antigenic target that is associated with a disease where a CAR, Adapter and/or CAR/Adapter combination can be used to treat the disease.

In a preferred embodiment, the CAR is expressed in a T cell and provides a method for treating or preventing cancer, comprising the administration of host cells expressing CAR to a cancer patient in which the cancer cell expresses a tumor antigen on its surface, and wherein the Adapter specifically binds the target antigen. Exemplary target antigenic determinants that the Adapter and CAR bind include, but are not limited to, BCMA, CS1, CD19, CD123, TSLPR, and CD267. In some embodiments, the CAR is expressed in a T cell and provides a method for treating multiple myeloma, comprising the administration of host cells expressing CAR to a multiple myeloma patient in which the tumor cell expresses BCMA and/or CS1 on its surface, and wherein the Adapter specifically binds BCMA, CS1, or BCMA and CS1.

Articles of manufacture, including kits containing the Adapter, CAR cell, and/or CAR cell/Adapter compositions, are provided herein. The article of manufacture may comprise a container and a label or package insert on or associated with the container. Suitable containers include, for example, bottles, vials or syringes. The containers may be formed from a variety of materials such as glass or plastic. The container holds one or more Adapter, CAR cell, nucleic acids encoding Adapter, and/or vectors or host cells of the present disclosure. The label or package insert may include directions for administering the Adapter, CAR cell, and/or CAR cell/Adapter compositions to a patient. Such kits have uses including, but not limited to, therapeutic applications of the Adapter, CAR cell, and/or CAR/Adapter compositions.

XI. Further Compositions and Methods Using Thereof

In some embodiments, the disclosure provides:
[1.] an engineered human immune effector cell comprising
a) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and
b) a genetic modification that eliminates the expression of the human CD45 AD on the engineered cell,
wherein the engineered cell is capable of directing an immune response to a CD45 AD expressing cell in an in vitro assay, and wherein the engineered cell does not express the CD45 AD;
[2.] the engineered cell according to [1], wherein the immune response is killing the CD45 AD expressing cell;
[3.] the engineered cell according to [1] or [2], wherein the CD45 AD is present in the human CD45R0 isoform but not in the human CD45RA, CD45RAB, or CD45RABC isoforms;
[4.] the engineered cell according to [1] or [2], wherein the CD45 AD is present in the human CD45RA isoform but not in the human CD45R0 isoform;

[5.] the engineered cell according to [1] or [2], wherein the CD45 AD is present in the human CD45R0 and CD45RABC isoforms;

[6.] the engineered cell according to any one of [1] to [5], wherein the ADBD competes with the UCHL-1, A6, or ODP4 antibody for binding to the CD45 AD in an in vitro binding assay;

[7.] the engineered cell according to any one of [1] to [5], wherein the ADBD competes with the 4KB5, MB1, KiB3, 2H4, or MT2 antibody for binding to the CD45 AD in an in vitro binding assay;

[8.] the engineered cell according to any one of [1] to [7], wherein the genetic modification is a deletion, insertion, or substitution in a gene or fragment thereof encoding the human CD45 AD;

[9.] the engineered cell according to [8], wherein the genetic modification is a deletion, insertion, or substitution that eliminates expression of human CD45;

[10.] the engineered cell according to any one of [1] to [9], wherein the genetic modification is a substitution of a gene or fragment thereof encoding the CD45 AD with a nucleotide sequence encoding a homologue, variant, or derivative of human CD45, wherein the encoded homologue, variant, or derivative does not comprise the human CD45 AD;

[11.] the engineered cell according to [10], wherein the homologue is a non-human primate CD45;

[12.] the engineered cell according to [10], wherein the variant is naturally occurring;

[13.] the engineered cell according to [10] or [12], wherein the variant or derivative is capable of signaling;

[14.] the engineered cell according to any one of [1] to [13], wherein the ADBD comprises a single-chain variable fragment (scFv);

[15.] the engineered cell according to any one of [1] to [13], wherein the ADBD comprises an alternative scaffold binding domain (ASBD);

[16.] the engineered cell according to any one of [1] to [13], wherein the ADBD comprises a D domain;

[17.] the engineered cell according to any one of [1] to [16], wherein the CAR comprises 2 or more ADBDs;

[18.] the engineered cell according to any one of [1] to [16], wherein the CAR comprises 2 ADBDs;

[19.] the engineered cell of [18], wherein the CAR comprises an ASBD and a scFv;

[20.] the engineered cell of [18], wherein the CAR comprises a D domain and a scFv;

[21.] the engineered cell of [18], wherein the CAR comprises 2 ASBDs;

[22.] the engineered cell of [18], wherein the CAR comprises 2 D domains;

[23.] the engineered cell of any one according to any one of [1] to [16], wherein the CAR comprises 2 scFvs;

[24.] the engineered cell according to any one of [1] to [16], wherein the CAR comprises 2 ASBDs;

[25.] the engineered cell according to any one of [1] to [16], wherein the CAR comprises 3, 4, or 5 ASBDs;

[26.] the engineered cell according to any one of [1] to [16], wherein the CAR comprises 2 D domains;

[27.] the engineered cell according to any one of [1] to [16], wherein the CAR comprises 3, 4, or 5 D domains;

[28.] the engineered cell according to any one of [17] to [27], wherein at least one ADBD specifically binds to an antigenic determinant of AFP, BCMA, CS1, CD123, CD19, CD20, CD22, or CD137;

[29.] the engineered cell according to any one of [17] to [27], wherein at least one ADBD specifically binds to AFP p26 or a variant thereof (e.g., a polypeptide comprising the amino acid sequence of SEQ ID NO: 16, 1117, 1118, 1119, 1120, 1121, 1122, or 1123);

[30.] the engineered cell according to any one of [17] to [27], wherein at least one ADBD comprises a sequence selected from SEQ ID NO: 841-984;

[31.] the engineered cell according to any one of [1] to [30], wherein the CAR intracellular domain is a signaling domain;

[32.] the engineered cell according to any one of [1] to [31], wherein the CAR intracellular domain comprises a primary signaling domain;

[33.] the engineered cell according to any one of [1] to [32], wherein the CAR intracellular domain comprises a CD3 primary signaling domain;

[34.] the engineered cell according to any one of [1] to [33], wherein the CAR intracellular domain further comprises a costimulatory signaling domain;

[35.] the engineered cell according to any one of [1] to [34], wherein the CAR intracellular domain comprises a costimulatory signaling domain selected from: CD28, 41BB, CD27, and CD134;

[36.] the engineered cell according to any one of [1] to [34], wherein the CAR intracellular domain comprises a 41BB costimulatory signaling domain;

[37.] the engineered cell according to any one of [1] to [36], wherein the immune effector cell is a T cell;

[38.] the engineered cell according to any one of [1] to [36], wherein the immune effector cell is an NK cell;

[39.] a method of killing a target cell comprising contacting the engineered cell according to any one of [1] to [38] with the target cell, wherein the target cell expresses human CD45;

[40.] the method according to [39], wherein the target cell expresses human CD45R0 or human CD45RA isoform;

[41.] a method of delivering an immune response to a target cell comprising contacting the engineered cell according to any one of [1] to [38] with the target cell, wherein the target cell expresses human CD45;

[42.] the method according to [41], wherein the target cell expresses human CD45R0 or human CD45RA isoform;

[43.] the method according to any one of [39] to [42], wherein the contacting is done in vitro;

[44.] the method according to any one of [39] to [42], wherein the contacting is done in vivo;

[45.] the method according to any one of [39] to [42], wherein the contacting is done ex vivo;

[46.] a method of directing an immune response to a target cell in a subject comprising administering to the subject in need thereof a therapeutically effective amount of the engineered cell according to any one of [1] to [38];

[47.] a method of treating a proliferative disorder, cancer, autoimmune disease, infection, or allograft rejection in a subject comprising administering to the subject in need thereof a therapeutically effective amount of the engineered cell according to any one of [1 to 38;

[48.] a method of depleting lymphocytes comprising administering to a subject in need thereof an effective amount of the engineered cell according to any one of [1] to [38];

[49.] a method of depleting memory T cell comprising administering to a subject in need thereof an effective amount of the engineered cell according to any one of [1] to [38];

[50.] the method according to [49], wherein the CD45 AD is a CD45RO specific AD;
[51.] a method of treating an autoimmune disease or disorder comprising administering to a subject in need thereof a therapeutically effective amount of the engineered cell according to any one of [1] to [38];
[52.] the method according to [51], wherein the CD45 AD is a CD45RO specific AD;
[53.] the method according to [51] or [52], wherein the autoimmune disease or disorder is Type I diabetes, systemic sclerosis, multiple sclerosis, rheumatoid arthritis, juvenile idiopathic arthritis, psoriasis, Inflammatory bowel disease (IBD), Crohn's disease, ulcerative colitis, or alopecia areata;
[54.] a method of conditioning a subject for transplantation comprising administering to the subject in need thereof an effective amount of the engineered cell according to any one of [1] to [38];
[55.] the method according to [54], wherein the transplantation is bone marrow transplantation (BMT);
[56.] the method according to [54], wherein the transplantation is hematopoietic stem cell transplantation (HSCT);
[57.] the method according to any one of [54] to [56], wherein the transplantation is autologous transplantation;
[58.] the method according to any one of [54] to [56], wherein the transplantation is allogeneic transplantation;
[59.] the method according to any one of [54] to [58], wherein the subject has hematological cancer;
[60.] the method according to any one of [54] to [59], wherein the subject has relapsed hematological cancer;
[61.] a method of treating a hematological cancer comprising administering to a subject in need thereof a therapeutically effective amount of the engineered cell according to any one of [1] to [38];
[62.] the method according to any one of [59] to [61], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;
[63.] the method according to any one of [59] to [61], wherein the hematological cancer is AML, CLL, or multiple myeloma;
[64.] an engineered human immune effector cell comprising
  a) a chimeric antigen receptor (CAR) comprising (1) a first antigenic determinant binding domain (ADBD) that specifically binds to a first antigenic determinant (AD), (2) a transmembrane domain, and (3) an intracellular domain; and
  b) a genetic modification that eliminates the expression of at least one human CD45 AD on the engineered cell,
  wherein the first AD is not the at least one human CD45 AD, wherein the engineered cell used in combination with an Adapter is capable of directing an immune response to a CD45 AD expressing cell in an in vitro assay, wherein the Adapter comprises the first AD and a second ADBD that specifically binds to the at least one human CD45 AD, and wherein the engineered cell does not express the at least one human CD45 AD;
[65.] the engineered cell according to [64], wherein the immune response is killing the CD45 AD expressing cell;
[66.] the engineered cell according to [64] or [65], wherein the at least one CD45 AD is present in the human CD45R0 isoform but not in the human CD45RA, CD45RAB, or CD45RABC isoforms;
[67.] the engineered cell according to [64] or [65], wherein the at least one CD45 AD is present in the human CD45RA isoform but not in the human CD45R0 isoform;
[68.] the engineered cell according to [64] or [65], wherein the at least one CD45 AD is present in the human CD45R0 and CD45RABC isoforms;
[69.] the engineered cell according to any one of [64] to [68], wherein the second ADBD competes with the UCHL-1, A6, or ODP4 antibody for binding to the CD45 AD in an in vitro binding assay;
[70.] the engineered cell according to any one of [64] to [68], wherein the second ADBD competes with the 4KB5, MB1, KiB3, 2H4, or MT2 antibody for binding to the CD45 AD in an in vitro binding assay;
[71.] the engineered cell according to any one of [64] to [70], wherein the genetic modification is a deletion, insertion, or substitution in a gene or fragment thereof encoding the human CD45 AD;
[72.] the engineered cell according to [71], wherein the genetic modification is a deletion, insertion, or substitution that eliminates expression of human CD45;
[73.] the engineered cell according to any one of [64] to [72], wherein the genetic modification is a substitution of a gene or fragment thereof encoding the CD45 AD with a nucleotide sequence encoding a homologue, variant, or derivative of human CD45, wherein the encoded homologue, variant, or derivative does not comprise the human CD45 AD;
[74.] the engineered cell according to [73], wherein the homologue is a non-human primate CD45;
[75.] the engineered cell according to [73], wherein the variant is naturally occurring;
[76.] the engineered cell according to [73] or [75], wherein the variant or derivative is capable of signaling;
[77.] the engineered cell according to any one of [64] to [76], wherein the ADBD comprises a single-chain variable fragment (scFv);
[78.] the engineered cell according to any one of [64] to [76], wherein the ADBD comprises an alternative scaffold binding domain (ASBD);
[79.] the engineered cell according to any one of [64] to [76], wherein the ADBD comprises a D domain;
[80.] the engineered cell according to any one of [64] to [79], wherein the first ADBD specifically binds to an antigenic determinant of AFP, BCMA, CS1, CD123, CD19, CD20, CD22, or CD137;
[81.] the engineered cell according to any one of [64] to [79], wherein the first ADBD specifically binds to AFP p26 or a variant thereof (e.g., a polypeptide comprising the amino acid sequence of SEQ ID NO: 16, 1117, 1118, 1119, 1120, 1121, 1122, or 1123),
[82.] the engineered cell according to any one of [64] to [79], wherein the first ADBD comprises a sequence selected from SEQ ID NO: 841-984;
[83.] the engineered cell according to any one of [64] to [82], wherein the CAR comprises 2 or more ADBDs;
[84.] the engineered cell according to any one of [64] to [82], wherein the CAR comprises 2 ADBDs;

[85.] the engineered cell of [84], wherein the CAR comprises an ASBD and a scFv;
[86.] the engineered cell of [84], wherein the CAR comprises a D domain and a scFv
[87.] the engineered cell of [84], wherein the CAR comprises 2 ASBDs;
[88.] the engineered cell of [84], wherein the CAR comprises 2 D domains;
[89.] the engineered cell of any one according to any one of [64] to [82], wherein the CAR comprises 2 scFvs;
[90.] the engineered cell of any one according to any one of [64] to [82], wherein the CAR comprises 2 ASBDs;
[91.] the engineered cell of any one according to any one of [64] to [82], wherein the CAR comprises 3, 4, or 5 ASBDs;
[92.] the engineered cell of any one according to any one of [64] to [82], wherein the CAR comprises 2 D domains;
[93.] the engineered cell of any one according to any one of [64] to [82], wherein the CAR comprises 3, 4, or 5 D domains;
[94.] the engineered cell according to any one of [64] to [93], wherein the CAR intracellular domain is a signaling domain;
[95.] the engineered cell according to any one of [64] to [94], wherein the CAR intracellular domain comprises a primary signaling domain;
[96.] the engineered cell according to any one of [64] to [95], wherein the CAR intracellular domain comprises a CD3ζ primary signaling domain;
[97.] the engineered cell according to any one of [64] to [96], wherein the CAR intracellular domain further comprises a costimulatory signaling domain;
[98.] the engineered cell according to any one of [64] to [97], wherein the CAR intracellular domain comprises a costimulatory signaling domain selected from: CD28, 41BB, CD27, and CD134;
[99.] the engineered cell according to any one of [64] to [97], wherein the CAR intracellular domain comprises a 41BB costimulatory signaling domain;
[100.] the engineered cell according to any one of [64] to [99], wherein the immune effector cell is a T cell;
[101.] the engineered cell according to any one of [64] to [99], wherein the immune effector cell is an NK cell;
[102.] a method of killing a target cell comprising contacting the engineered cell according to any one of [64] to [101] with an Adapter and the target cell, wherein the target cell expresses CD45, and wherein the Adapter comprises the first AD and a second ADBD that specifically binds to a human CD45 AD;
[103.] a method of delivering an immune response to a target cell comprising contacting the engineered cell according to any one of [64] to [101] with an Adapter and the target cell, wherein the target cell expresses CD45, and wherein the Adapter comprises the first AD and a second ADBD that specifically binds to a human CD45 AD;
[104.] the method according to [102] or [103], wherein the target cell expresses human CD45R0 or human CD45RA isoform;
[105.] a method of treating hematological cancer comprising contacting the engineered cell according to any one of [64] to [101] with an Adapter and a cancer cell, wherein the cancer cell expresses CD45, and wherein the Adapter comprises the first AD and a second ADBD that specifically binds to a human CD45 AD;
[106.] the method according to any one of [102] to [106], wherein the contacting is done in vitro;
[107.] the method according to any one of [102] to [106], wherein the contacting is done in vivo;
[108.] the method according to any one of [102] to [106], wherein the contacting is done ex vivo;
[109.] a method of directing an immune response to a target cell in a subject comprising
   a) administering to the subject in need thereof a therapeutically effective amount of the engineered cell according to any one of [64] to [101]; and
   b) administering to the subject a therapeutically effective amount of an Adapter comprising the first AD and a second ADBD that specifically binds to a human CD45 AD;
[110.] a method of directing an immune response to a target cell in a subject comprising administering to the subject in need thereof a therapeutically effective amount of the engineered cell according to any one of [64] to [101], wherein the subject has been administered an Adapter comprising the first AD and a second ADBD that specifically binds to a human CD45 AD;
[111.] a method of directing an immune response to a target cell in a subject comprising administering to a subject in need thereof a therapeutically effective amount of an Adapter comprising the first AD and a second ADBD that specifically binds to a human CD45 AD, wherein the subject has been administered the engineered cell according to any one of [64] to [101];
[112.] a method of treating a proliferative disorder, cancer, autoimmune disease, infection, or allograft rejection in a subject comprising
   a) administering to the subject in need thereof a therapeutically effective amount of the engineered cell according to any one of [64] to [101]; and
   b) administering to the subject a therapeutically effective amount of an Adapter comprising the first AD and a second ADBD that specifically binds to a human CD45 AD;
[113.] a method of treating a proliferative disorder, cancer, autoimmune disease, infection, or allograft rejection in a subject comprising administering to the subject in need thereof a therapeutically effective amount of the engineered cell according to any one of [64] to [101], wherein the subject has been administered an Adapter comprising the first AD and a second ADBD that specifically binds to a human CD45 AD;
[114.] a method of treating a proliferative disorder, cancer, autoimmune disease, infection, or allograft rejection in a subject comprising administering to a subject in need thereof a therapeutically effective amount of an Adapter comprising the first AD and a second ADBD that specifically binds to a human CD45 AD, wherein the subject has been administered the engineered cell according to any one of [64] to [101];
[115.] a method of depleting lymphocytes comprising
   a) administering to a subject in need thereof a therapeutically effective amount of the engineered cell according to any one of [64] to [101]; and
   b) administering to the subject a therapeutically effective amount of an Adapter comprising the first AD and a second ADBD that specifically binds to a human CD45 AD;
[116.] a method of depleting lymphocytes comprising administering to a subject in need thereof a therapeutically effective amount of the engineered cell according to any one of [64] to [101], wherein the subject has been administered an Adapter comprising the first AD and a second ADBD that specifically binds to a human CD45 AD;

[117.] a method of depleting lymphocytes comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[118.] a method of depleting memory T cell comprising
  a) administering to a subject in need thereof a therapeutically effective amount of the engineered cell according to any one of [64] to [101]; and
  b) administering to the subject a therapeutically effective amount of an Adapter comprising the first AD and a second ADBD that specifically binds to a human CD45 AD;

[119.] a method of depleting memory T cell comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[120.] a method of depleting memory T cell comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[121.] the method according to any one of [118] to [120], wherein the human CD45 AD is a CD45RO specific AD;

[122.] a method of treating an autoimmune disease or disorder comprising
  a) administering to a subject in need thereof a therapeutically effective amount of the engineered cell according to any one of [64] to [101]; and
  b) administering to the subject a therapeutically effective amount of an Adapter comprising the first AD and a second ADBD that specifically binds to a human CD45 AD;

[123.] a method of treating an autoimmune disease or disorder comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[124.] a method of treating an autoimmune disease or disorder comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[125.] the method according to any one of [122] to [124], wherein the human CD45 AD is a CD45RO specific AD;

[126.] the method according to any one of [124] to [125], wherein the autoimmune disease or disorder is Type I diabetes, systemic sclerosis, multiple sclerosis, rheumatoid arthritis, juvenile idiopathic arthritis, psoriasis, Inflammatory bowel disease (IBD), Crohn's disease, ulcerative colitis, or alopecia areata;

[127.] a method of conditioning a subject for transplantation comprising
  a) administering to a subject in need thereof a therapeutically effective amount of the engineered cell according to any one of [64] to [101]; and
  b) administering to the subject a therapeutically effective amount of an Adapter comprising the first AD and a second ADBD that specifically binds to a human CD45 AD;

[128.] a method of conditioning a subject for transplantation comprising administering to a subject in need thereof a therapeutically effective amount of the engineered cell according to any one of [64] to [101], wherein the subject has been administered an Adapter comprising the first AD and a second ADBD that specifically binds to a human CD45 AD;

[129.] a method of conditioning a subject for transplantation comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[130.] the method according to any one of [127] to [129], wherein the transplantation is bone marrow transplantation (BMT);

[131.] the method according to any one of [127] to [129], wherein the transplantation is hematopoietic stem cell transplantation (HSCT);

[132.] the method according to any one of [127] to [131], wherein the transplantation is autologous transplantation;

[133.] the method according to any one of [127] to [131], wherein the transplantation is allogeneic transplantation;

[134.] the method according to any one of [127] to [133], wherein the subject has hematological cancer;

[135.] the method according to any one of [127] to [133], wherein the subject has relapsed hematological cancer;

[136.] a method of treating a hematological cancer comprising
  a) administering to a subject in need thereof a therapeutically effective amount of the engineered cell according to any one of [64] to [101]; and
  b) administering to the subject a therapeutically effective amount of an Adapter comprising the first AD and a second ADBD that specifically binds to a human CD45 AD;

[137.] a method of treating a hematological cancer comprising administering to a subject in need thereof a therapeutically effective amount of the engineered cell according to any one of [64] to [101], wherein the subject has been administered an Adapter comprising the first AD and a second ADBD that specifically binds to a human CD45 AD;

[138.] a method of treating a hematological cancer comprising administering to a subject in need thereof a therapeutically effective amount of an Adapter comprising the first AD and a second ADBD that specifically binds to a human CD45 AD, wherein the subject has been administered the engineered cell according to any one of [64] to [101];

[139.] the method according to any one of [127] to [139], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;

[140.] the method according to any one of [127] to [139], wherein the hematological cancer is AML, CLL, or multiple myeloma;

[141.] the method according to any one of [64] to [140], wherein the CD45 AD is present in the human CD45R0 isoform but not in the human CD45RA, CD45RAB, or CD45RABC isoforms;

[142.] the method according to any one of [64] to [140], wherein the CD45 AD is present in the human CD45RA isoform but not in the human CD45R0 isoform;

[143.] the method according to any one of [64] to [140], wherein the CD45 AD is present in the human CD45R0 and CD45RABC isoforms;

[144.] the method according to any one of [64] to [143], wherein the second ADBD competes with the UCHL-1, A6, or ODP4 antibody for binding to the CD45 AD in an in vitro binding assay;

[145.] the method according to any one of [64] to [143], wherein the second ADBD competes with the 4KB5, MB1, KiB3, 2H4, or MT2 antibody for binding to the CD45 AD in an in vitro binding assay;

[146.] an engineered human immune effector cell comprising:
  a) a chimeric antigen receptor (CAR), wherein the CAR comprises (i) two or more antigenic determinant binding domains (ADBD) comprising a first ADBD that bind to a first antigenic determinants (AD), (ii) a transmembrane domain, and (iii) an intracellular domain; and
  b) a genetic modification that eliminates the expression of the first AD on the engineered cell, wherein the engineered cell does not express the first AD;

[147.] the engineered cell according to [146], wherein the first AD is a human CD45 AD;

[148.] the engineered cell according to [146] or [147], wherein the CD45 AD is present in the human CD45R0 isoform but not in the human CD45RA, CD45RAB, or CD45RABC isoforms;

[149.] the engineered cell according to [146] or [147], wherein the CD45 AD is present in the human CD45RA isoform but not in the human CD45R0 isoform;

[150.] the engineered cell according to [146] or [147], wherein the CD45 AD is present in the human CD45R0 and CD45RABC isoforms;

[151.] the engineered cell according to [146], wherein the first AD is a human CD26, CD30, CD33, or CD38 AD;

[152.] the engineered cell according to any one of [146] to [151], wherein the two or more ADBDs bind to ADs expressed on the same target cell;

[153.] the engineered cell according to any one of [146] to [151], wherein the two or more ADBDs bind to ADs expressed on different target cells;

[154.] the engineered cell according to any one of [146] to [153], wherein the genetic modification is a deletion, insertion, or substitution in a gene or fragment thereof encoding a polypeptide comprising the first AD;

[155.] the engineered cell according to any one of [146] to [154], wherein the genetic modification is a substitution of a gene or fragment thereof encoding a polypeptide comprising the first AD with a nucleotide sequence encoding a homologue, variant, or derivative of the polypeptide comprising the first AD, wherein the encoded homologue, variant, or derivative does not comprise the first AD;

[156.] the engineered cell according to [155], wherein the homologue is a non-human primate homologue;

[157.] the engineered cell according to [155], wherein the variant is naturally occurring;

[158.] the engineered cell according to [155] or [157], wherein the variant or derivative is capable of signaling;

[159.] the engineered cell according to any one of [146] to [158], wherein the CAR comprises 2 ADBDs that bind to different targets;

[160.] the engineered cell according to any one of [146] to [159], wherein the CAR comprises 2 ADBDs that (a) are the same, (b) bind to the same AD, (c) bind to different ADs of the same antigen, (d) bind to different ADs on the same cell, or (e) bind to different ADs on different cells;

[161.] the engineered cell according to any one of [146] to [160], wherein the first ADBD specifically binds to an antigenic determinant of AFP, BCMA, CS1, CD123, CD19, CD20, CD22, or CD137;

[162.] the engineered cell according to any one of [146] to [160], wherein the first ADBD specifically binds to AFP p26, or a variant thereof (e.g., a polypeptide comprising the amino acid sequence of SEQ ID NO: 16, 1117, 1118, 1119, 1120, 1121, 1122, or 1123);

[163.] the engineered cell according to any one of [146] to [160], wherein the first ADBD comprises a sequence selected from SEQ ID NO: 841-984;

[164.] the engineered cell according to any one of [146] to [163], wherein the CAR specifically binds to an antigen selected from: CD19, CD22, CD123, CS1, HER2, BCMA, TACI, BAFFR, and PDL1;

[165.] the engineered cell according to any one of [146] to [163], wherein the CAR specifically binds to BCMA, and optionally wherein the CAR comprises a sequence selected from SEQ ID NO: 44-338, and 339;

[166.] the engineered cell according to any one of [146] to [163], wherein the CAR specifically binds to CD123, and optionally wherein the CAR comprises a sequence selected from SEQ ID NO: 340-772 and 773;

[167.] the engineered cell according to any one of [146] to [163], wherein the CAR specifically binds to CD19, and optionally wherein the CAR comprises a sequence selected from SEQ ID NO: 1030-1058, and 1059;

[168.] the engineered cell according to any one of [146] to [163], wherein the CAR specifically binds to CD22, and optionally wherein the CAR comprises a sequence selected from SEQ ID NO: 1060-1068, and 1069;

[169.] the engineered cell according to any one of [146] to [163], wherein the CAR specifically binds to CS1, and optionally wherein the CAR comprises a sequence selected from SEQ ID NO: 780-794, and 796;

[170.] the engineered cell according to any one of [146] to [163], wherein the CAR specifically binds to PDL1, and optionally wherein the CAR comprises a sequence selected from SEQ ID NO: 1010-1016, 1074-1078, and 1079;

[171.] the engineered cell according to any one of [146] to [170], wherein the CAR comprises 2 ADBDs;

[172.] the engineered cell of [171], wherein the CAR comprises an ASBD and a scFv;

[173.] the engineered cell of [171], wherein the CAR comprises a D domain and a scFv

[174.] the engineered cell of [171], wherein the CAR comprises 2 ASBDs;
[175.] the engineered cell of [171], wherein the CAR comprises 2 D domains;
[176.] the engineered cell of any one according to any one of [146] to [170], wherein the CAR comprises 2 scFvs;
[177.] the engineered cell of any one according to any one of [146] to [170], wherein the CAR comprises 2 ASBDs;
[178.] the engineered cell of any one according to any one of [146] to [170], wherein the CAR comprises 3, 4, or 5 ASBDs;
[179.] the engineered cell of any one according to any one of [146] to [170], wherein the CAR comprises 2 D domains;
[180.] the engineered cell of any one according to any one of [146] to [170], wherein the CAR comprises 3, 4, or 5 D domains;
[181.] the engineered cell according to any one of [146] to [180], wherein the CAR intracellular domain is a signaling domain;
[182.] the engineered cell according to any one of [146] to [181], wherein the CAR intracellular domain comprises a primary signaling domain;
[183.] the engineered cell according to any one of [146] to [182], wherein the CAR intracellular domain comprises a CD3ζ primary signaling domain;
[184.] the engineered cell according to any one of [146] to [183], wherein the CAR intracellular domain further comprises a costimulatory signaling domain;
[185.] the engineered cell according to any one of [146] to [184], wherein the CAR intracellular domain comprises a costimulatory signaling domain selected from: CD28, 41BB, CD27, and CD134;
[186.] the engineered cell according to any one of [146] to [184], wherein the CAR intracellular domain comprises a 41BB costimulatory signaling domain;
[187.] the engineered cell according to any one of [146] to [186], wherein the immune effector cell is a T cell;
[188.] the engineered cell according to any one of [146] to [186], wherein the immune effector cell is an NK cell;
[189.] a method of killing a target cell comprising contacting the engineered cell according to any one of to [188] with the target cell;
[190.] the method according to [189], wherein the target cell expresses human CD45;
[191.] the method according to [189], wherein the target cell expresses human CD45R0 or human CD45RA isoform;
[192.] a method of delivering an immune response to a target cell comprising contacting the engineered cell according to any one of [146] to [188] with the target cell;
[193.] the method according to [192], wherein the target cell expresses human CD45;
[194.] the method according to [192], wherein the target cell expresses human CD45R0 or human CD45RA isoform;
[195.] the method according to any one of [189] to [194], wherein the contacting is done in vitro;
[196.] the method according to any one of [189] to [194], wherein the contacting is done in vivo;
[197.] the method according to any one of [189] to [194], wherein the contacting is done ex vivo;
[198.] a method of directing an immune response to a target cell in a subject comprising administering to the subject in need thereof a therapeutically effective amount of the engineered cell according to any one of [146] to [188];
[199.] a method of treating a proliferative disorder, cancer, autoimmune disease, infection, or allograft rejection in a subject comprising administering to the subject in need thereof a therapeutically effective amount of the engineered cell according to any one of [146] to [188];
[200.] a method of depleting lymphocytes comprising administering to a subject in need thereof an effective amount of the engineered cell according to any one of [146] to [188];
[201.] a method of conditioning a subject for transplantation comprising administering to the subject in need thereof an effective amount of the engineered cell according to any one of [146] to [188];
[202.] the method according to [201], wherein the transplantation is bone marrow transplantation (BMT);
[203.] the method according to [201], wherein the transplantation is hematopoietic stem cell transplantation (HSCT);
[204.] the method according to any one of [201] to [203], wherein the transplantation is autologous transplantation;
[205.] the method according to any one of [201] to [203], wherein the transplantation is allogeneic transplantation;
[206.] the method according to any one of [201] to [205], wherein the subject has hematological cancer;
[207.] the method according to any one of [201] to [205], wherein the subject has relapsed hematological cancer;
[208.] a method of treating a hematological cancer comprising administering to a subject in need thereof a therapeutically effective amount of the engineered cell according to any one of [146] to [188];
[209.] the method according to any one of [206] to [208], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;
[210.] the method according to any one of [206] to [208], wherein the hematological cancer is AML, CLL, or multiple myeloma;
[211.] a method of killing a target cell comprising contacting the engineered cell according to any one of to [188] with an Adapter and the target cell, wherein the Adapter comprises an AD recognized by the CAR and a second ADBD;
[212.] a method of delivering an immune response to a target cell comprising contacting the engineered cell according to any one of [146] to [188] with an Adapter and the target cell, and wherein the Adapter comprises an AD recognized by the CAR and a second ADBD that is capable of binding a second AD on the target cell;
[213.] a method of treating hematological cancer comprising contacting the engineered cell according to any one of [146] to [188] with an Adapter and a cancer cell, wherein the Adapter comprises an AD recognized by the CAR and a second ADBD that is capable of binding a second AD on the cancer cell;
[214.] the method according to any one of [211] to [213], wherein the contacting is done in vitro;
[215.] the method according to any one of [211] to [213], wherein the contacting is done in vivo;

[216.] the method according to any one of [211] to [213], wherein the contacting is done ex vivo;

[217.] a method of directing an immune response to a target cell in a subject comprising
 a) administering to the subject in need thereof a therapeutically effective amount of the engineered cell according to any one of [146] to [188]; and
 b) administering to the subject a therapeutically effective amount of an Adapter comprising an AD recognized by the CAR and a second ADBD that is capable of binding a second AD on the target cell;

[218.] a method of directing an immune response to a target cell in a subject comprising administering to the subject in need thereof a therapeutically effective amount of the engineered cell according to any one of [146] to [188], wherein the subject has been administered an Adapter comprising an AD recognized by the CAR and a second ADBD that is capable of binding a second AD on the target cell;

[219.] a method of directing an immune response to a target cell in a subject comprising administering to a subject in need thereof a therapeutically effective amount of an Adapter comprising an AD recognized by the CAR and a second ADBD that is capable of binding a second AD on the target cell, wherein the subject has been administered the engineered cell according to any one of [146] to [188];

[220.] a method of treating a proliferative disorder, cancer, autoimmune disease, infection, or allograft rejection in a subject comprising
 a) administering to the subject in need thereof a therapeutically effective amount of the engineered cell according to any one of [146] to [188]; and
 b) administering to the subject a therapeutically effective amount of an Adapter comprising an AD recognized by the CAR and a second ADBD that is capable of binding a second AD on a target cell;

[221.] a method of treating a proliferative disorder, cancer, autoimmune disease, infection, or allograft rejection in a subject comprising administering to the subject in need thereof a therapeutically effective amount of the engineered cell according to any one of [146] to [188], wherein the subject has been administered an Adapter comprising an AD recognized by the CAR and a second ADBD that is capable of binding a second AD on a target cell;

[222.] a method of treating a proliferative disorder, cancer, autoimmune disease, infection, or allograft rejection in a subject comprising administering to a subject in need thereof a therapeutically effective amount of an Adapter comprising an AD recognized by the CAR and a second ADBD that is capable of binding a second AD on a target cell, wherein the subject has been administered the engineered cell according to any one of [146] to [188];

[223.] a method of depleting lymphocytes comprising
 a) administering to a subject in need thereof a therapeutically effective amount of the engineered cell according to any one of [146] to [188]; and
 b) administering to the subject a therapeutically effective amount of an Adapter comprising an AD recognized by the CAR and a second ADBD that is capable of binding a second AD on a target cell;

[224.] a method of depleting lymphocytes comprising administering to a subject in need thereof a therapeutically effective amount of the engineered cell according to any one of [146] to [188], wherein the subject has been administered an Adapter comprising an AD recognized by the CAR and a second ADBD that is capable of binding a second AD on a target cell;

[225.] a method of depleting lymphocytes comprising administering to a subject in need thereof a therapeutically effective amount of an Adapter comprising an AD recognized by the CAR and a second ADBD that is capable of binding a second AD on a target cell, wherein the subject has been administered the engineered cell according to any one of [146] to [188];

[226.] a method of conditioning a subject for transplantation comprising
 a) administering to a subject in need thereof a therapeutically effective amount of the engineered cell according to any one of [146] to [188]; and
 b) administering to the subject a therapeutically effective amount of an Adapter comprising an AD recognized by the CAR and a second ADBD that is capable of binding a second AD on a target cell;

[227.] a method of conditioning a subject for transplantation comprising administering to a subject in need thereof a therapeutically effective amount of the engineered cell according to any one of to [188], wherein the subject has been administered an Adapter comprising an AD recognized by the CAR and a second ADBD that is capable of binding a second AD on a target cell;

[228.] a method of conditioning a subject for transplantation comprising administering to a subject in need thereof a therapeutically effective amount of an Adapter comprising an AD recognized by the CAR and a second ADBD that is capable of binding a second AD on a target cell, wherein the subject has been administered the engineered cell according to any one of [146] to [188];

[229.] the method according to any one of [226] to [228], wherein the transplantation is bone marrow transplantation (BMT);

[230.] the method according to any one of [226] to [228], wherein the transplantation is hematopoietic stem cell transplantation (HSCT);

[231.] the method according to any one of [226] to [230], wherein the transplantation is autologous transplantation;

[232.] the method according to any one of [226] to [230], wherein the transplantation is allogeneic transplantation;

[233.] the method according to any one of [226] to [232], wherein the subject has hematological cancer;

[234.] the method according to any one of [226] to [232], wherein the subject has relapsed hematological cancer;

[235.] a method of treating a hematological cancer comprising
 a) administering to a subject in need thereof a therapeutically effective amount of the engineered cell according to any one of [146] to [188]; and
 b) administering to the subject a therapeutically effective amount of an Adapter comprising an AD recognized by the CAR and a second ADBD that is capable of binding a second AD on a target cell;

[236.] a method of treating a hematological cancer comprising administering to a subject in need thereof a therapeutically effective amount of the engineered cell according to any one of [146] to [188], wherein the subject has been administered an Adapter comprising an AD recognized by the CAR and a second ADBD that is capable of binding a second AD on a target cell;

[237.] a method of treating a hematological cancer comprising administering to a subject in need thereof a therapeutically effective amount of an Adapter comprising an AD recognized by the CAR and a second ADBD that is capable of binding a second AD on a target cell, wherein the subject has been administered the engineered cell according to any one of [146] to [188];

[238.] the method according to any one of [233] to [237], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;

[239.] the method according to any one of [233] to [237], wherein the hematological cancer is AML, CLL, or multiple myeloma;

[240.] an engineered human immune effector cell comprising:
  a) a chimeric antigen receptor (CAR), wherein the CAR comprises (i) a first antigenic determinant binding domain (ADBD) that specifically binds to a first antigenic determinant (AD), (ii) a transmembrane domain, and (iii) an intracellular domain; and
  b) a genetic modification that eliminates the expression of a second AD on the engineered cell, wherein the engineered cell used in combination with an Adapter is capable of directing an immune response to a cell expressing the second AD in an in vitro assay, wherein the Adapter comprises the first AD and a second ADBD that specifically binds to the second AD, and wherein the engineered cell does not express the second AD;

[241.] the engineered cell according to [240], wherein the immune response is killing the cell expressing the second AD;

[242.] the engineered cell according to [240] or [241], wherein the second AD is a human CD45 AD;

[243.] the engineered cell according to [242], wherein the CD45 AD is present in the human CD45R0 isoform but not in the human CD45RA, CD45RAB, or CD45RABC isoforms;

[244.] the engineered cell according to [242], wherein the CD45 AD is present in the human CD45RA isoform but not in the human CD45R0 isoform;

[245.] the engineered cell according to [242], wherein the CD45 AD is present in the human CD45R0 and CD45RABC isoforms;

[246.] the engineered cell according to [240] or [241], wherein the second AD is a human CD26, CD30, CD33, or CD38 AD;

[247.] the engineered cell according to any one of [240] to [246], wherein the first AD is not expressed on a target cell and the second AD is expressed on a target cell;

[248.] the engineered cell according to any one of [240] to [246], wherein the first AD is expressed on a target cell;

[249.] the engineered cell according to any one of [240] to [246], wherein the first AD and the second AD are expressed on the same target cell;

[250.] the engineered cell according to any one of [240] to [246], wherein the first AD and the second AD are expressed on different target cells;

[251.] the engineered cell according to any one of [240] to [250], wherein the genetic modification is a deletion, insertion, or substitution in a gene or fragment thereof encoding a polypeptide comprising the second AD;

[252.] the engineered cell according to any one of [240] to [250], wherein the genetic modification is a substitution of a gene or fragment thereof encoding a polypeptide comprising the second AD with a nucleotide sequence encoding a homologue, variant, or derivative of the polypeptide comprising the second AD, wherein the encoded homologue, variant, or derivative does not comprise the second AD;

[253.] the engineered cell of [252], wherein the homologue is a non-human primate homologue;

[254.] the engineered cell of [252], wherein the variant is naturally occurring;

[255.] the engineered cell of [252] or [254], wherein the variant or derivative is capable of signaling;

[256.] the engineered cell according to any one of [240] to [255], wherein the first ADBD comprises a single-chain variable fragment (scFv);

[257.] the engineered cell according to any one of [240] to [255], wherein the first ADBD comprises an alternative scaffold binding domain (ASBD);

[258.] the engineered cell according to any one of [240] to [255], wherein the first ADBD comprises a D domain;

[259.] the engineered cell according to any one of [240] to [258], wherein the first ADBD specifically binds to an antigenic determinant of AFP, BCMA, CS1, CD123, CD19, CD20, CD22, or CD137;

[260.] the engineered cell according to any one of [240] to [258], wherein the first ADBD specifically binds to AFP p26, or a variant thereof (e.g., a polypeptide comprising the amino acid sequence of SEQ ID NO: 16, 1117, 1118, 1119, 1120, 1121, 1122, or 1123);

[261.] the engineered cell according to any one of [240] to [258], wherein the first ADBD comprises a sequence selected from SEQ ID NO: 841-984;

[262.] the engineered cell according to any one of [240] to [261], wherein the CAR comprises 2 or more ADBDs;

[263.] the engineered cell according to any one of [240] to [261], wherein the CAR comprises 2 ADBDs;

[264.] the engineered cell of [263], wherein the CAR comprises an ASBD and a scFv;

[265.] the engineered cell of [263], wherein the CAR comprises a D domain and a scFv;

[266.] the engineered cell of [263], wherein the CAR comprises 2 ASBDs;

[267.] the engineered cell of [263], wherein the CAR comprises 2 D domains;

[268.] the engineered cell of any one according to any one of [240] to [261], wherein the CAR comprises 2 scFvs;

[269.] the engineered cell of any one according to any one of [240] to [261], wherein the CAR comprises 2 ASBDs;

[270.] the engineered cell of any one according to any one of [240] to [261], wherein the CAR comprises 3, 4, or 5 ASBDs;

[271.] the engineered cell of any one according to any one of [240] to [261], wherein the CAR comprises 2 D domains;

[272.] the engineered cell of any one according to any one of [240] to [261], wherein the CAR comprises 3, 4, or 5 D domains;

[273.] an engineered human immune effector cell comprising:
  a) a chimeric antigen receptor (CAR), wherein the CAR comprises (i) two or more antigenic determinant binding domains (ADBD) comprising a first ADBD that specifically binds to a first antigenic determinants (AD), (ii) a transmembrane domain, and (iii) an intracellular domain; and
  b) a genetic modification that eliminates the expression of a second AD on the engineered cell, wherein the engineered cell used in combination with an Adapter is capable of directing an immune response to a cell expressing the second AD in an in vitro assay, wherein the Adapter comprises the first AD and a second ADBD that specifically binds to the second AD, and wherein the engineered cell does not express the second AD;

[274.] the engineered cell according to [273], wherein the immune response is killing the cell expressing the second AD;

[275.] the engineered cell according to [273] or [274], wherein the second AD is a human CD45 AD;

[276.] the engineered cell according to [275], wherein the CD45 AD is present in the human CD45R0 isoform but not in the human CD45RA, CD45RAB, or CD45RABC isoforms;

[277.] the engineered cell according to [275], wherein the CD45 AD is present in the human CD45RA isoform but not in the human CD45R0 isoform;

[278.] the engineered cell according to [275], wherein the CD45 AD is present in the human CD45R0 and CD45RABC isoforms;

[279.] the engineered cell according to [273] or [274], wherein the second AD is a human CD26, CD30, CD33, or CD38 AD;

[280.] the engineered cell according to any one of [273] to [279], wherein the first AD is expressed on a target cell;

[281.] the engineered cell according to any one of [273] to [279], wherein the first AD and the second AD are expressed on the same target cell;

[282.] the engineered cell according to any one of [273] to [279], wherein the first AD and the second AD are expressed on different target cells;

[283.] the engineered cell according to any one of [273] to [282], wherein the genetic modification is a deletion, insertion, or substitution in a gene or fragment thereof encoding a polypeptide comprising the second AD;

[284.] the engineered cell according to any one of [273] to [282], wherein the genetic modification is a substitution of a gene or fragment thereof encoding a polypeptide comprising the second AD with a nucleotide sequence encoding a homologue, variant, or derivative of the polypeptide comprising the second AD, wherein the encoded homologue, variant, or derivative does not comprise the second AD;

[285.] the engineered cell of [284], wherein the homologue is a non-human primate homologue;

[286.] the engineered cell of [284], wherein the variant is naturally occurring;

[287.] the engineered cell of [284] or [286], wherein the variant or derivative is capable of signaling;

[288.] the engineered cell according to any one of [273] to [287], wherein the first ADBD comprises a single-chain variable fragment (scFv);

[289.] the engineered cell according to any one of [273] to [287], wherein the first ADBD comprises an alternative scaffold binding domain (ASBD);

[290.] the engineered cell according to any one of [273] to [287], wherein the first ADBD comprises a D domain;

[291.] the engineered cell according to any one of [273] to [287], wherein the CAR comprises 2 ADBDs;

[292.] the engineered cell of [291], wherein the CAR comprises an ASBD and a scFv;

[293.] the engineered cell of [291], wherein the CAR comprises a D domain and a scFv

[294.] the engineered cell of [291], wherein the CAR comprises 2 ASBDs;

[295.] the engineered cell of [291], wherein the CAR comprises 2 D domains;

[296.] the engineered cell of any one according to any one of [273] to [287], wherein the CAR comprises 2 scFvs;

[297.] the engineered cell of any one according to any one of [273] to [287], wherein the CAR comprises 2 ASBDs;

[298.] the engineered cell of any one according to any one of [273] to [287], wherein the CAR comprises 3, 4, or 5 ASBDs;

[299.] the engineered cell of any one according to any one of [273] to [287], wherein the CAR comprises 2 D domains;

[300.] the engineered cell of any one according to any one of [273] to [287], wherein the CAR comprises 3, 4, or 5 D domains;

[301.] the engineered cell according to any one of [273] to [300], wherein the first ADBD specifically binds to an antigenic determinant of AFP, BCMA, CS1, CD123, CD19, CD20, CD22, or CD137;

[302.] the engineered cell according to any one of [273] to [300], wherein the first ADBD specifically binds to AFP p26, or a variant thereof (e.g., a polypeptide comprising the amino acid sequence of SEQ ID NO: 16, 1117, 1118, 1119, 1120, 1121, 1122, or 1123),

[303.] the engineered cell according to any one of [273] to [300], wherein the first ADBD comprises a sequence selected from SEQ ID NO: 841-984;

[304.] the engineered cell according to any one of [273] to [303], wherein the CAR comprises 2 ADBDs that bind to different targets;

[305.] the engineered cell according to any one of [273] to [303], wherein the CAR comprises 2 ADBDs that (a) are the same, (b) bind to the same AD, (c) bind to different ADs of the same antigen, (d) bind to different ADs on the same cell, or (e) bind to different ADs on different cells;

[306.] the engineered cell according to any one of [273] to [305], wherein the CAR specifically binds to an antigen selected from: CD19, CD22, CD123, BCMA, CS1, TACI, BAFFR, and PDL1;

[307.] the engineered cell according to any one of [273] to [305], wherein the CAR specifically binds to BCMA, and optionally wherein the CAR comprises a sequence selected from SEQ ID NO: SEQ ID NO: 44-338, and 339; or the engineered cell according to any one of [273] to [305], wherein the CAR specifically binds to CS1;

[308.] the engineered cell according to any one of [273] to [305], wherein the CAR specifically binds to CD123, and optionally wherein the CAR comprises a sequence selected from SEQ ID NO: 340-772 and 773;

[309.] the engineered cell according to any one of [273] to [305], wherein the CAR specifically binds to CD19, and optionally wherein the CAR comprises a sequence selected from SEQ ID NO: 1030-1058, and 1059;

[310.] the engineered cell according to any one of [273] to [305], wherein the CAR specifically binds to CD22, and optionally wherein the CAR comprises a sequence selected from SEQ ID NO: 1060-1068, and 1069;

[311.] the engineered cell according to any one of [273] to [305], wherein the CAR specifically binds to CS1, and optionally wherein the CAR comprises a sequence selected from SEQ ID NO: 780-794, and 795;

[312.] the engineered cell according to any one of [273] to [305], wherein the CAR specifically binds to PDL1, and optionally wherein the CAR comprises a sequence selected from SEQ ID NO: 1010-1016, 1074-1078, and 1079;

[313.] the engineered cell according to any one of [240] to [312], wherein the CAR intracellular domain is a signaling domain;

[314.] the engineered cell according to any one of [240] to [313], wherein the CAR intracellular domain comprises a primary signaling domain;

[315.] the engineered cell according to any one of [240] to [314], wherein the CAR intracellular domain comprises a CD3 primary signaling domain;

[316.] the engineered cell according to any one of [240] to [315], wherein the CAR intracellular domain further comprises a costimulatory signaling domain;

[317.] the engineered cell according to any one of [240] to [316], wherein the CAR intracellular domain comprises a costimulatory signaling domain selected from: CD28, 41BB, CD27, and CD134;

[318.] the engineered cell according to any one of [240] to [316], wherein the CAR intracellular domain comprises a 41BB costimulatory signaling domain;

[319.] the engineered cell according to any one of [240] to [318], wherein the immune effector cell is a T cell;

[320.] the engineered cell according to any one of [240] to [318], wherein the immune effector cell is an NK cell;

[321.] a method of killing a target cell comprising contacting the engineered cell according to any one of to [320] with the target cell;

[322.] the method according to [321], wherein the target cell expresses human CD45;

[323.] the method according to [321], wherein the target cell expresses human CD45R0 or human CD45RA isoform;

[324.] a method of delivering an immune response to a target cell comprising contacting the engineered cell according to any one of [240] to [320] with the target cell;

[325.] the method according to [324], wherein the target cell expresses human CD45;

[326.] the method according to [324], wherein the target cell expresses human CD45R0 or human CD45RA isoform;

[327.] the method according to any one of [321] to [326], wherein the contacting is done in vitro;

[328.] the method according to any one of [321] to [326], wherein the contacting is done in vivo;

[329.] the method according to any one of [321] to [326], wherein the contacting is done ex vivo;

[330.] a method of directing an immune response to a target cell in a subject comprising administering to the subject in need thereof a therapeutically effective amount of the engineered cell according to any one of [240] to [320];

[331.] a method of treating a proliferative disorder, cancer, autoimmune disease, infection, or allograft rejection in a subject comprising administering to the subject in need thereof a therapeutically effective amount of the engineered cell according to any one of [240] to [320];

[332.] a method of depleting lymphocytes comprising administering to a subject in need thereof an effective amount of the engineered cell according to any one of [240] to [320];

[333.] a method of conditioning a subject for transplantation comprising administering to the subject in need thereof an effective amount of the engineered cell according to any one of [240] to [320];

[334.] the method according to [333], wherein the transplantation is bone marrow transplantation (BMT);

[335.] the method according to [333], wherein the transplantation is hematopoietic stem cell transplantation (HSCT);

[336.] the method according to any one of [333] to [335], wherein the transplantation is autologous transplantation;

[337.] the method according to any one of [333] to [335], wherein the transplantation is allogeneic transplantation;

[338.] the method according to any one of [333] to [337], wherein the subject has hematological cancer;

[339.] the method according to any one of [333] to [337], wherein the subject has relapsed hematological cancer;

[340.] a method of treating a hematological cancer comprising administering to a subject in need thereof a therapeutically effective amount of the engineered cell according to any one of [240] to [320];

[341.] the method according to any one of [338] to [340], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;

[342.] the method according to any one of [338] to [340], wherein the hematological cancer is AML, CLL, or multiple myeloma;

[343.] a method of killing a target cell comprising contacting the engineered cell according to any one of to [320] with an Adapter and the target cell, wherein the Adapter comprises the first AD and a second ADBD that specifically binds to the second AD, and wherein the second AD is expressed on the target cell;

[344.] a method of delivering an immune response to a target cell comprising contacting the engineered cell according to any one of [240] to [320] with an Adapter and the target cell, wherein the Adapter comprises the first AD and a second ADBD that specifically binds to the second AD, and wherein the second AD is expressed on the target cell;

[345.] a method of treating hematological cancer comprising contacting the engineered cell according to any one of [240] to [320] with an Adapter and a cancer cell, wherein the Adapter comprises the first AD and a second ADBD that specifically binds to the second AD, and wherein the second AD is expressed on the cancer cell;

[346.] the method according to any one of [343] to [345], wherein the contacting is done in vitro;

[347.] the method according to any one of [343] to [345], wherein the contacting is done in vivo;

[348.] the method according to any one of [343] to [345], wherein the contacting is done ex vivo;

[349.] a method of directing an immune response to a target cell in a subject comprising
  a) administering to the subject in need thereof a therapeutically effective amount of the engineered cell according to any one of [240] to [320]; and
  b) administering to the subject a therapeutically effective amount of an Adapter comprising the first AD and a second ADBD that specifically binds to the second AD, wherein the second AD is expressed on the target cell;

[350.] a method of directing an immune response to a target cell in a subject comprising administering to the subject in need thereof a therapeutically effective amount of the engineered cell according to any one of [240] to [320], wherein the subject has been administered an Adapter comprising the first AD and a second ADBD that specifically binds to the second AD, and wherein the second AD is expressed on the target cell;

[351.] a method of directing an immune response to a target cell in a subject comprising administering to a subject in need thereof a therapeutically effective amount of an Adapter comprising the first AD and a second ADBD that specifically binds to the second AD, wherein the subject has been administered the engineered cell according to any one of [240] to [320], and wherein the second AD is expressed on the target cell;

[352.] a method of treating a proliferative disorder, cancer, autoimmune disease, infection, or allograft rejection in a subject comprising
  a) administering to the subject in need thereof a therapeutically effective amount of the engineered cell according to any one of [240] to [320]; and
  b) administering to the subject a therapeutically effective amount of an Adapter comprising the first AD and a second ADBD that specifically binds to the second AD, wherein the second AD is expressed on a target cell associated with the proliferative disorder, cancer, autoimmune disease, infection, or allograft rejection;

[353.] a method of treating a proliferative disorder, cancer, autoimmune disease, infection, or allograft rejection in a subject comprising administering to the subject in need thereof a therapeutically effective amount of the engineered cell according to any one of [240] to [320], wherein the subject has been administered an Adapter comprising the first AD and a second ADBD that specifically binds to the second AD, and wherein the second AD is expressed on a target cell associated with the proliferative disorder, cancer, autoimmune disease, infection, or allograft rejection;

[354.] a method of treating a proliferative disorder, cancer, autoimmune disease, infection, or allograft rejection in a subject comprising administering to a subject in need thereof a therapeutically effective amount of an Adapter comprising the first AD and a second ADBD that specifically binds to the second AD, wherein the subject has been administered the engineered cell according to any one of [240] to [320], and wherein the second AD is expressed on a target cell associated with the proliferative disorder, cancer, autoimmune disease, infection, or allograft rejection;

[355.] a method of depleting lymphocytes comprising
  a) administering to a subject in need thereof a therapeutically effective amount of the engineered cell according to any one of [240] to [320]; and
  b) administering to the subject a therapeutically effective amount of an Adapter comprising the first AD and a second ADBD that specifically binds to the second AD, wherein the second AD is expressed on a lymphocyte target cell;

[356.] a method of depleting lymphocytes comprising administering to a subject in need thereof a therapeutically effective amount of the engineered cell according to any one of [240] to [320], wherein the subject has been administered an Adapter comprising the first AD and a second ADBD that specifically binds to the second AD, and wherein the second AD is expressed on a lymphocyte target cell;

[357.] a method of depleting lymphocytes comprising administering to a subject in need thereof a therapeutically effective amount of an Adapter comprising the first AD and a second ADBD that specifically binds to the second AD, wherein the subject has been administered the engineered cell according to any one of [240] to [320], and wherein the second AD is expressed on a lymphocyte target cell;

[358.] a method of conditioning a subject for transplantation comprising
  a) administering to a subject in need thereof a therapeutically effective amount of the engineered cell according to any one of [240] to [320]; and
  b) administering to the subject a therapeutically effective amount of an Adapter comprising the first AD and a second ADBD that specifically binds to the second AD, wherein the second AD is expressed on a target cell associated with the transplantation;

[359.] a method of conditioning a subject for transplantation comprising administering to a subject in need thereof a therapeutically effective amount of the engineered cell according to any one of to [320], wherein the subject has been administered an Adapter comprising the first AD and a second ADBD that specifically binds to the second AD, and wherein the second AD is expressed on a target cell associated with the transplantation;

[360.] a method of conditioning a subject for transplantation comprising administering to a subject in need thereof a therapeutically effective amount of an Adapter comprising the first AD and a second ADBD that specifically binds to the second AD, wherein the subject has been administered the engineered cell according to any one of [240] to [320], and wherein the second AD is expressed on a target cell associated with the transplantation;

[361.] the method according to any one of [358] to [360], wherein the transplantation is bone marrow transplantation (BMT);

[362.] the method according to any one of [358] to [360], wherein the transplantation is hematopoietic stem cell transplantation (HSCT);

[363.] the method according to any one of [358] to [362], wherein the transplantation is autologous transplantation;

[364.] the method according to any one of [358] to [362], wherein the transplantation is allogeneic transplantation;

[365.] the method according to any one of [358] to [364], wherein the subject has hematological cancer;

[366.] the method according to any one of [358] to [364], wherein the subject has relapsed hematological cancer;

[367.] a method of treating a hematological cancer comprising
a) administering to a subject in need thereof a therapeutically effective amount of the engineered cell according to any one of [240] to [320]; and
b) administering to the subject a therapeutically effective amount of an Adapter comprising the first AD and a second ADBD that specifically binds to the second AD, wherein the second AD is expressed on a target cell associated with the hematological cancer;

[368.] a method of treating a hematological cancer comprising administering to a subject in need thereof a therapeutically effective amount of the engineered cell according to any one of [240] to [320], wherein the subject has been administered an Adapter comprising the first AD and a second ADBD that specifically binds to the second AD, and wherein the second AD is expressed on a target cell associated with the hematological cancer;

[369.] a method of treating a hematological cancer comprising administering to a subject in need thereof a therapeutically effective amount of an Adapter comprising the first AD and a second ADBD that specifically binds to the second AD, wherein the subject has been administered the engineered cell according to any one of [240] to [320], and wherein the second AD is expressed on a target cell associated with the hematological cancer;

[370.] the method according to any one of [358] to [369], wherein the hematological cancer is selected from: acute leukemia, chronic leukemia, polycythemia vera, lymphoma, Hodgkin's disease, non-Hodgkin's lymphoma, multiple myeloma, Waldenstrom's macroglobulinemia, heavy chain disease, myelodysplastic syndrome, hairy cell leukemia, and myelodysplasia;

[371.] the method according to any one of [358] to [369], wherein the hematological cancer is AML, CLL, or multiple myeloma;

[372.] an isolated Adapter polypeptide comprising (a) an antigenic determinant (AD) and (b) one or more antigenic determinant binding domain (ADBD), wherein at least one ADBD specifically binds to a human CD45 AD, and wherein contacting the Adaptor with a CD45 AD expressing target cell in the presence of an engineered cell according to [64] is capable of directing an immune response by the engineered cell to the target cell in an in vitro assay;

[373.] the Adapter polypeptide according to [372], wherein the immune response is killing the CD45 AD expressing cell;

[374.] the Adapter polypeptide according to [372] or [373], wherein the CD45 AD is present in the human CD45R0 isoform but not in the human CD45RA, CD45RAB, or CD45RABC isoforms;

[375.] the Adapter polypeptide according to [372] or [373], wherein the CD45 AD is present in the human CD45RA isoform but not in the human CD45R0 isoform;

[376.] the Adapter polypeptide according to [372] or [373], wherein the CD45 AD is present in the human CD45R0 and CD45RABC isoforms;

[377.] the Adapter polypeptide according to [372] or [373], which competes with the UCHL-1, A6, or ODP4 antibody for binding to the CD45 AD in an in vitro binding assay; or

[378.] the Adapter polypeptide according to [372] or [373], which competes with the 4KB5, MB1, KiB3, 2H4, or MT2 antibody for binding to the CD45 AD in an in vitro binding assay.

The term "CD45" as used herein refers to protein tyrosine phosphatase, receptor type C (PTPRC), also known as Leukocyte Common Antigen (LCA), LYS, B220, L-CA, T200, CD45R, GP180. The term "CD45" includes variants, isoforms, homologues, orthologs and paralogs. CD45 is a glycosylated type I transmembrane protein, various isoforms of which are expressed on the surface of all hematopoietic cells, except erythrocytes and plasma cells. CD45 is also expressed in lymphomas, B-cell chronic lymphocytic leukemia, hairy cell leukemia, and acute nonlymphocytic leukemia. CD45 is expressed in multiple isoforms as a result of alternative splicing of variable CD45 exons. The CD45 gene comprises 34 exons, of which exon 4 encoding peptide A, exon 5 encoding peptide B, and exon 6 encoding peptide C are alternatively spliced to generate different isoforms. The CD45R isoform, comprising peptides A, B, and C, is the longest. The CD45RO isoform, which lacks peptides A, B, and C, is the shortest. Isoforms CD45RA, CD45RB, CD45RC, CD45RAB, CD45RAC, and CD45RBC comprise the corresponding combinations of peptides A, B, and C. In some embodiments, the amino acid sequence of human CD45RABC, comprising a 25 amino acid residue N-terminal signal sequence (MTMYLWLKLLAFGFAFLDTEVFVTG, SEQ ID NO: 1101), has Genbank Accession No. NP_002829.3 (SEQ ID NO: 1102). Peptides A, B, and C correspond to residues 34-99, 100-146, and 147-194 of SEQ ID NO: 1102, respectively. In some embodiments, the amino acid sequence of human CD45RO, comprising the 25 amino acid residue N-terminal signal sequence of SEQ ID NO: 1101, has Genbank Accession No. NP_563578.2 (SEQ ID NO: 1103).

Only the CD45RA, CD45RO, CD45RB, CD45RAB, CD45RBC and CD45RABC isoforms are traditionally identified in humans. CD45RA is expressed on naïve T cells. The CD45RO isoform is expressed on activated and memory T cells, some B cell subsets, activated monocytes/macrophages, and granulocytes. CD45RB is a 220 kD glycoprotein expressed on peripheral B cells, naïve T cells, thymocytes, weakly on macrophages, and dendritic cells. As T cells become activated and progress from naïve to memory cells, CD45RB expression is downregulated. Additionally, functionally distinct $CD4^+$ T cell subsets, which secrete differing cytokine profiles, can be separated by CD45RB intensity.

The extracellular domain of the different CD45 isoforms comprise overlapping sets of antigenic determinants. CD45 reactive monoclonal antibodies have been categorized based on their specificity towards the different isoforms. An anti-CD45 antibody, as used herein refers to an antibody that specifically binds to CD45RO, CD45RB, CD45RAB, CD45RBC and CD45RABC isoforms. An anti-CD45RA antibody, as used herein refers to an antibody that specifically binds to CD45RA, CD45RAB, or CD45RABC isoforms, but does not bind to CD45RB or CD45RO. Anti-CD45RA antibodies include, but are not limited to, 4KB5, MB1, KiB3, MT2. An anti-CD45RB antibody, as used herein refers to an antibody that specifically binds to CD45RB, CD45RAB, CD45RBC, or CD45RABC, but does not bind to CD45RA, and CD45RO. An anti-CD45RO antibody, as used herein refers to an antibody that specifically binds to CD45RO, but does not bind to the other isoforms. CD45RO specific antibodies include, but are not limited to, UCHL1, A6, OPD4. In some embodiments, a CD45 specific antigenic determinant binding domain (ADBD) disclosed herein specifically binds to CD45RO, but does not bind to the other CD45 isoforms. In some embodiments, a CD45 specific ADBD disclosed herein specifically binds to CD45RA, CD45RAB, and CD45RABC, but does not bind to the other CD45 isoforms. In some embodiments, a CD45 specific ADBD disclosed herein specifically binds to all CD45 isoforms. Cell type specific glycosylation of CD45 contributes to the formation of human CD45 antigenic determinants. For example, differential expression of the antigenic determinant bound by the CD45RB$^{MEM55}$ antibody is regulated by cell type specific O-linked glycosylation during B cell development. Koethe et al., Journal of Leukocyte Biology, 90(1): 5-19. Expression of the antigenic determinant bound by the UCHL1 and A6 antibodies are also dependent on the glycosylation of the CD45RO isoform. In some embodiments, a CD45 specific ADBD disclosed herein specifically binds to a glycosylation dependent antigenic determinant of human CD45. In some embodiments, a CD45 specific ADBD disclosed herein specifically binds to a glycosylation dependent antigenic determinant of human CD45RB. In some embodiments, a CD45 specific ADBD disclosed herein specifically binds to a glycosylation dependent antigenic determinant of human CD45RO.

The term "non-human primate CD45" as used herein refers to a primate ortholog of human CD45. In some embodiments, the non-human primate CD45 is a rhesus CD45. In some embodiments, the amino acid sequence of rhesus (*Macaca mulatta*) CD45RABC, comprising an N-terminal signal sequence, has Genbank Accession No. XP_014976209 (SEQ ID NO: 1104). In some embodiments, the non-human primate CD45 is a cynomolgus CD45. In some embodiments, the amino acid sequence of cynomolgus (*Macaca fascicularis*) CD45RABC, comprising an N-terminal signal sequence, has Genbank Accession No. XP_005540386 (SEQ ID NO: 1105). Due to differences in their primary amino acid sequence, human CD45 and non-human primate CD45s comprise different sets of antigenic determinants. In some embodiments, a human CD45 specific ADBD disclosed herein specifically binds to an antigenic determinant that is also present in a non-human primate CD45. In some embodiments, a human CD45 specific ADBD disclosed herein specifically binds to an antigenic determinant that is not present in a non-human primate CD45. In some embodiments, a human CD45 specific ADBD disclosed herein specifically binds to an antigenic determinant that is not present in a rhesus CD45. In some embodiments, a human CD45 specific ADBD disclosed herein specifically binds to an antigenic determinant that is not present in a cynomolgus CD45.

In some embodiments, the AD (e.g., in an Adapter and/or on a target cell) is an epitope of human CD45. In some embodiments, the AD is an epitope of the extracellular domain (ECD) of human CD45. In some embodiments, the AD is an epitope of the ECD of human CD45RA. In some embodiments, the AD is an epitope of the ECD of human CD45RB. In some embodiments, the AD is an epitope of the ECD of human CD45RAB. In some embodiments, the AD is an epitope of the ECD of human CD45RBC. In some embodiments, the AD is an epitope of the ECD of human CD45RAC. In some embodiments, the AD is an epitope of the ECD of human CD45RABC. In some embodiments, the AD is an epitope of the ECD of human CD45RO. In further embodiments, the AD comprises 5-25, 5-50, 5-75, 5-100, 5-125, or 5-150 amino acid residues, more than 150 amino acid residues, or all of the amino acid residues of SEQ ID NO: 1106. In further embodiments, the AD comprises 5-25, 5-50, 5-75, 5-100, 5-125, or 5-150 amino acid residues, more than 150 amino acid residues, or all of the amino acid residues of SEQ ID NO: 1107. In further embodiments, the AD comprises 5-25, 5-50, 5-75, 5-100, 5-125, or 5-150 amino acid residues, more than 150 amino acid residues, or all of the amino acid residues of SEQ ID NO: 1108. In further embodiments, the AD comprises 5-25, 5-50, 5-75, 5-100, 5-125, or 5-150 amino acid residues, more than 150 amino acid residues, or all of the amino acid residues of SEQ ID NO: 1109. In further embodiments, the AD comprises 5-25, 5-50, 5-75, 5-100, 5-125, or 5-150 amino acid residues, more than 150 amino acid residues, or all of the amino acid residues of SEQ ID NO: 1110. In further embodiments, the AD comprises 5-25, 5-50, 5-75, 5-100, 5-125, or 5-150 amino acid residues, more than 150 amino acid residues, or all of the amino acid residues of SEQ ID NO: 1111. In further embodiments, the AD comprises 5-25, 5-50, 5-75, 5-100, 5-125, or 5-150 amino acid residues, more than 150 amino acid residues, or all of the amino acid residues of SEQ ID NO: 1112.

In some embodiments, the AD is a glycosylation dependent epitope of human CD45.

In some embodiments, the AD is an epitope of human CD45 that is not present in a non-human primate CD45. In some embodiments, the AD is an epitope of human CD45 that is not present in a rhesus CD45. In some embodiments, the AD is an epitope of human CD45 that is not present in a cynomolgus CD45.

In some embodiments, the AD is an epitope of human CD45 that is bound by the UCHL-1, A6, or ODP4 antibody. In some embodiments, the AD is an epitope of human CD45 that is bound by the 4KB5, MB1, KiB3, 2H4, or MT2 antibody.

In some embodiments, the AD is an epitope of CD26. In further embodiments, the AD comprises 5-25, 5-50, 5-75, 5-100, 5-125, or 5-150 amino acid residues, more than 150 amino acid residues, or all of the amino acid residues of residues 29-766 of SEQ ID NO: 1113.

In some embodiments, the AD is an epitope of CD30. In further embodiments, the AD comprises 5-25, 5-50, 5-75, 5-100, 5-125, or 5-150 amino acid residues, more than 150 amino acid residues, or all of the amino acid residues of residues 19-379 of SEQ ID NO: 1114.

In some embodiments, the AD is an epitope of CD33. In further embodiments, the AD comprises 5-25, 5-50, 5-75, 5-100, 5-125, or 5-150 amino acid residues, more than 150 amino acid residues, or all of the amino acid residues of residues 18-259 of SEQ ID NO: 1115.

In some embodiments, the AD is an epitope of CD38. In further embodiments, the AD comprises 5-25, 5-50, 5-75, 5-100, 5-125, or 5-150 amino acid residues, more than 150 amino acid residues, or all of the amino acid residues of residues 43-300 of SEQ ID NO: 1116.

In some embodiments of the compositions and methods disclosed herein, the ADBD has the ability to bind to an antigenic determinant expressed on the surface of an immune effector cells. In some embodiments, the ADBD has the ability to bind to an antigenic determinant of human CD45. In some embodiments, the ADBD has the ability to bind to an antigenic determinant of human CD45R, CD45RA, CD45RB, or CD45RO. In some embodiments, the ADBD has the ability to bind to an antigenic determinant of human CD45RA. In some embodiments, the ADBD has the ability to bind to an antigenic determinant of human CD45RB. In some embodiments, the ADBD has the ability to bind to an antigenic determinant of human CD45RO. In some embodiments, the ADBD has the ability to bind to an antigenic determinant of human CD45, but does not have the ability to bind to a non-human primate homologue of CD45. In some embodiments, the ADBD has the ability to bind to an antigenic determinant of human CD45, but does not have the ability to bind to rhesus or cynomolgus CD45. In some embodiments, the ADBD has the ability to bind to an antigenic determinant of human CD45R, CD45RA, CD45RB, or CD45RO, but does not have the ability to bind to a non-human primate homologue of CD45. In some embodiments, the ADBD has the ability to bind to an antigenic determinant of human CD45R, CD45RA, CD45RB, or CD45RO, but does not have the ability to bind to rhesus or cynomolgus CD45. In some embodiments, the ADBD has the ability to bind to an antigenic determinant of human CD45RO, but does not have the ability to bind to a non-human primate homologue of CD45. In some embodiments, the ADBD has the ability to bind to an antigenic determinant of human CD45RO, but does not have the ability to bind to rhesus or cynomolgus CD45. In some embodiments, the ADBD has the ability to bind to an antigenic determinant of human CD26, CD30, CD33, or CD38. In some embodiments, the ADBD has the ability to bind to an antigenic determinant of human CD26, CD30, CD33, or CD38, but does not have the ability to bind to a non-human primate homologue of CD26, CD30, CD33, or CD38, respectively. In some embodiments, the ADBD has the ability to bind to an antigenic determinant of human CD26, CD30, CD33, or CD38, but does not have the ability to bind to rhesus or cynomolgus CD26, CD30, CD33, or CD38, respectively.

In some embodiments, the ADBD is a D domain-based polypeptide that has the ability to bind to an antigenic determinant of human CD45. In some embodiments, the ADBD is a D domain-based polypeptide that has the ability to bind to an antigenic determinant of human CD45R, CD45RA, CD45RB, or CD45RO. In some embodiments, the ADBD is a D domain-based polypeptide that has the ability to bind to an antigenic determinant of human CD45RO. In some embodiments, the ADBD is a D domain-based polypeptide that has the ability to bind to an antigenic determinant of human CD45RA. In some embodiments, the ADBD is a D domain-based polypeptide that has the ability to bind to an antigenic determinant of human CD45RB. In some embodiments, the ADBD is a D domain-based polypeptide that has the ability to bind to an antigenic determinant of human CD45, but does not have the ability to bind to a non-human primate homologue of CD45. In some embodiments, the ADBD is a D domain-based polypeptide that has the ability to bind to an antigenic determinant of human CD45, but does not have the ability to bind to rhesus or cynomolgus CD45. In some embodiments, the ADBD is a D domain-based polypeptide that has the ability to bind to an antigenic determinant of human CD45R, CD45RA, CD45RB, or CD45RO, but does not have the ability to bind to a non-human primate homologue of CD45. In some embodiments, the ADBD is a D domain-based polypeptide that has the ability to bind to an antigenic determinant of human CD45R, CD45RA, CD45RB, or CD45RO, but does not have the ability to bind to rhesus or cynomolgus CD45. In some embodiments, the ADBD is a D domain-based polypeptide that has the ability to bind to an antigenic determinant of human CD45RO, but does not have the ability to bind to a non-human primate homologue of CD45. In some embodiments, the ADBD is a D domain-based polypeptide that has the ability to bind to an antigenic determinant of human CD45RO, but does not have the ability to bind to rhesus or cynomolgus CD45. In some embodiments, the ADBD is a D domain-based polypeptide that has the ability to bind to an antigenic determinant of human CD26, CD30, CD33, or CD38. In some embodiments, the ADBD is a D domain-based polypeptide that has the ability to bind to an antigenic determinant of human CD26, CD30, CD33, or CD38, but does not have the ability to bind to a non-human primate homologue of CD26, CD30, CD33, or CD38, respectively. In some embodiments, the ADBD is a D domain-based polypeptide that has the ability to bind to an antigenic determinant of human CD26, CD30, CD33, or CD38, but does not have the ability to bind to rhesus or cynomolgus CD26, CD30, CD33, or CD38, respectively.

In some embodiments, the ADBD (e.g., of an Adapter and/or CAR) specifically binds to an AD of human CD45. In some embodiments, the ADBD specifically binds to an AD of the extracellular domain (ECD) of human CD45. In some embodiments, the ADBD specifically binds to an AD of the ECD of human CD45RA. In some embodiments, the ADBD specifically binds to an AD of the ECD of human CD45RB. In some embodiments, the ADBD specifically binds to an AD of the ECD of human CD45RAB. In some embodiments, the ADBD specifically binds to an AD of the ECD of human CD45RBC. In some embodiments, the ADBD specifically binds to an AD of the ECD of human CD45RAC. In some embodiments, the ADBD specifically binds to an AD of the ECD of human CD45RABC. In some embodiments, the ADBD specifically binds to an AD of the ECD of human CD45RO. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1106. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1107. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1108. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1109. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1110. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1111. In some embodiments, the ADBD specifically binds to an AD of comprising 5-25, 5-50, 5-75, 5-100, 5-125, or 5-150 amino acid residues, more than 150 amino acid residues, or all of the amino acid residues of SEQ ID NO: 1112.

In some embodiments, the ADBD specifically binds to a glycosylation dependent epitope of human CD45.

In some embodiments, the ADBD specifically binds to an epitope of human CD45 that is not present in a non-human primate CD45. In some embodiments, the ADBD specifically binds to an epitope of human CD45 that is not present in a rhesus CD45. In some embodiments, the ADBD specifically binds to of human CD45 that is not present in a cynomolgus CD45.

In some embodiments, the ADBD specifically binds to the same epitope of human CD45 that is bound by the UCHL-1, A6, or ODP4 antibody. In some embodiments, the ADBD specifically binds to the same epitope of human CD45 that is bound by the 4KB5, MB1, KiB3, 2H4, or MT2 antibody.

In some embodiments, the ADBD specifically binds to an epitope of human CD45 that overlaps with the epitope bound by the UCHL-1, A6, or ODP4 antibody. In some embodiments, the ADBD specifically binds to an epitope of human CD45 that overlaps with the epitope bound by the 4KB5, MB1, KiB3, 2H4, or MT2 antibody.

In some embodiments, the ADBD competes with a reference antibody for binding to human CD45 in an in vitro binding assay, wherein the reference antibody is UCHL-1, A6, or ODP4. In some embodiments, the ADBD competes with a reference antibody for binding to human CD45 in an in vitro binding assay, wherein the reference antibody is 4KB5, MB1, KiB3, 2H4, or MT2.

In some embodiments, the ADBD specifically binds to an AD of CD26. In further embodiments, the AD comprises 5-25, 5-50, 5-75, 5-100, 5-125, or 5-150 amino acid residues, more than 150 amino acid residues, or all of the amino acid residues of residues 29-766 of SEQ ID NO: 1113.

In some embodiments, the ADBD specifically binds to an AD of CD30. In further embodiments, the AD comprises 5-25, 5-50, 5-75, 5-100, 5-125, or 5-150 amino acid residues, more than 150 amino acid residues, or all of the amino acid residues of residues 19-379 of SEQ ID NO: 1114.

In some embodiments, the ADBD specifically binds to an AD of CD33. In further embodiments, the AD comprises 5-25, 5-50, 5-75, 5-100, 5-125, or 5-150 amino acid residues, more than 150 amino acid residues, or all of the amino acid residues of residues 18-259 of SEQ ID NO: 1115.

In some embodiments, the ADBD specifically binds to an AD of CD38. In further embodiments, the AD comprises 5-25, 5-50, 5-75, 5-100, 5-125, or 5-150 amino acid residues, more than 150 amino acid residues, or all of the amino acid residues of residues 43-300 of SEQ ID NO: 1116.

In some embodiments, the ADBD specifically binds to an AD of human CD45. In some embodiments, the ADBD specifically binds to an AD of human CD26, CD30, CD33, or CD38.

In some embodiments, the ADBD comprises a fragment of an antibody that is sufficient to confer recognition and specific binding to an AD of human CD45. In some embodiments, the ADBD comprises a fragment of an antibody that is sufficient to confer recognition and specific binding to an AD of human CD26, CD30, CD33, or CD38.

In some embodiments, the ADBD is a scFv that (e.g., of an Adapter and/or CAR) specifically binds to an AD of human CD45. In some embodiments, the ADBD is a scFv that specifically binds to an AD of the extracellular domain (ECD) of human CD45. In some embodiments, the ADBD is a scFv that specifically binds to an AD of the ECD of human CD45RA. In some embodiments, the ADBD is a scFv that specifically binds to an AD of the ECD of human CD45RB. In some embodiments, the ADBD is a scFv that specifically binds to an AD of the ECD of human CD45RAB. In some embodiments, the ADBD is a scFv that specifically binds to an AD of the ECD of human CD45RBC. In some embodiments, the ADBD is a scFv that specifically binds to an AD of the ECD of human CD45RAC. In some embodiments, the ADBD is a scFv that specifically binds to an AD of the ECD of human CD45RABC. In some embodiments, the ADBD is a scFv that specifically binds to an AD of the ECD of human CD45RO. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1106. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1107. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1108. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1109. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1110. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1111. In some embodiments, the ADBD is a scFv that specifically binds to an AD of comprising 5-25, 5-50, 5-75, 5-100, 5-125, or 5-150 amino acid residues, more than 150 amino acid residues, or all of the amino acid residues of SEQ ID NO: 1112.

In some embodiments, the ADBD is a scFv that specifically binds to a glycosylation dependent epitope of human CD45.

In some embodiments, the ADBD is a scFv that specifically binds to an epitope of human CD45 that is not present in a non-human primate CD45. In some embodiments, the ADBD is a scFv that specifically binds to an epitope of human CD45 that is not present in a rhesus CD45. In some embodiments, the ADBD is a scFv that specifically binds to of human CD45 that is not present in a cynomolgus CD45.

In some embodiments, the ADBD is a scFv that specifically binds to the same epitope of human CD45 that is bound by the UCHL-1, A6, or ODP4 antibody. In some embodiments, the ADBD is a scFv that specifically binds to the same epitope of human CD45 that is bound by the 4KB5, MB1, KiB3, 2H4, or MT2 antibody.

In some embodiments, the ADBD is a scFv that specifically binds to an epitope of human CD45 that overlaps with the epitope bound by the UCHL-1, A6, or ODP4 antibody. In some embodiments, the ADBD is a scFv that specifically binds to an epitope of human CD45 that overlaps with the epitope bound by the 4KB5, MB1, KiB3, 2H4, or MT2 antibody.

In some embodiments, the ADBD is a scFv that competes with a reference antibody for binding to human CD45 in an in vitro binding assay, wherein the reference antibody is UCHL-1, A6, or ODP4. In some embodiments, the ADBD is a scFv that competes with a reference antibody for binding to human CD45 in an in vitro binding assay, wherein the reference antibody is 4KB5, MB1, KiB3, 2H4, or MT2.

In some embodiments, the ADBD is an scFv that specifically binds to an AD of human CD26, CD30, CD33, or CD38.

In some embodiments, the ADBD is a SDAB that specifically binds to an AD of human CD45. In some embodiments, the ADBD is a SDAB that specifically binds to an AD of human CD26, CD30, CD33, or CD38.

In some embodiments, the ADBD comprises a human antibody or a fragment thereof that specifically binds to an AD of human CD45. In some embodiments, the ADBD comprises a human antibody or a fragment thereof that specifically binds to an AD of human CD26, CD30, CD33, or CD38.

In some embodiments, the ADBD comprises a humanized antibody or a fragment thereof that specifically binds to an AD of human CD45. In some embodiments, the ADBD comprises a humanized antibody or a fragment thereof that specifically binds to an AD of human CD26, CD30, CD33, or CD38.

In some embodiments, the ADBD is an ASBD that specifically binds to an AD of human CD45. In some embodiments, the ADBD is an ASBD that specifically binds to an AD of human CD26, CD30, CD33, or CD38.

In some embodiments, the ASBD specifically binds to an AD of human CD45. In some embodiments, the ASBD specifically binds to an AD of human CD26, CD30, CD33, or CD38.

In some embodiments, the ASBD specifically binds to an AD of human CD45. In some embodiments, the ASBD specifically binds to an AD of human CD26, CD30, CD33, or CD38.

In some embodiments, the ADBD is a D domain that (e.g., of an Adapter and/or CAR) specifically binds to an AD of human CD45. In some embodiments, the ADBD is a D domain that specifically binds to an AD of the extracellular domain (ECD) of human CD45. In some embodiments, the ADBD is a D domain that specifically binds to an AD of the ECD of human CD45RA. In some embodiments, the ADBD is a D domain that specifically binds to an AD of the ECD of human CD45RB. In some embodiments, the ADBD is a D domain that specifically binds to an AD of the ECD of human CD45RAB. In some embodiments, the ADBD is a D domain that specifically binds to an AD of the ECD of human CD45RBC. In some embodiments, the ADBD is a D domain that specifically binds to an AD of the ECD of human CD45RAC. In some embodiments, the ADBD is a D domain that specifically binds to an AD of the ECD of human CD45RABC. In some embodiments, the ADBD is a D domain that specifically binds to an AD of the ECD of human CD45RO. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1106. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1107. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1108. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1109. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1110. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1111. In some embodiments, the ADBD is a D domain that specifically binds to an AD of comprising 5-25, 5-50, 5-75, 5-100, 5-125, or 5-150 amino acid residues, more than 150 amino acid residues, or all of the amino acid residues of SEQ ID NO: 1112.

In some embodiments, the ADBD is a D domain that specifically binds to a glycosylation dependent epitope of human CD45.

In some embodiments, the ADBD is a D domain that specifically binds to an epitope of human CD45 that is not present in a non-human primate CD45. In some embodiments, the ADBD is a D domain that specifically binds to an epitope of human CD45 that is not present in a rhesus CD45. In some embodiments, the ADBD is a D domain that specifically binds to of human CD45 that is not present in a cynomolgus CD45.

In some embodiments, the ADBD is a D domain that specifically binds to the same epitope of human CD45 that is bound by the UCHL-1, A6, or ODP4 antibody. In some embodiments, the ADBD is a D domain that specifically binds to the same epitope of human CD45 that is bound by the 4KB5, MB1, KiB3, 2H4, or MT2 antibody.

In some embodiments, the ADBD is a D domain that specifically binds to an epitope of human CD45 that overlaps with the epitope bound by the UCHL-1, A6, or ODP4 antibody. In some embodiments, the ADBD is a D domain that specifically binds to an epitope of human CD45 that overlaps with the epitope bound by the 4KB5, MB1, KiB3, 2H4, or MT2 antibody.

In some embodiments, the ADBD is a D domain that competes with a reference antibody for binding to human CD45 in an in vitro binding assay, wherein the reference antibody is UCHL-1, A6, or ODP4. In some embodiments, the ADBD is a D domain that competes with a reference antibody for binding to human CD45 in an in vitro binding assay, wherein the reference antibody is 4KB5, MB1, KiB3, 2H4, or MT2.

In some embodiments, the ASBD is a D-domain that specifically binds to an AD of human CD26, CD30, CD33, or CD38.

In some embodiments, the ASBD is a Z-domain scaffold-based binding domain that specifically binds to an AD of human CD45. In some embodiments, the ASBD is a Z-domain scaffold-based binding domain that specifically binds to an AD of human CD26, CD30, CD33, or CD38.

In some embodiments, the ASBD is a DARPin-based AD binding domain that specifically binds to an AD of human CD45. In some embodiments, the ASBD is a DARPin-based AD binding domain that specifically binds to an AD of human CD26, CD30, CD33, or CD38.

In some embodiments, the ASBD is an adnectin-based AD binding domain that specifically binds to an AD of human CD45. In some embodiments, the ASBD is an adnectin-based AD binding domain that specifically binds to an AD of human CD26, CD30, CD33, or CD38.

In some embodiments, the ASBD is a lipocalin-, affilin-, or anticalin-based AD binding domain that specifically binds to an AD of human CD45. In some embodiments, the ASBD is a lipocalin-, affilin-, or anticalin-based AD binding domain that specifically binds to an AD of human CD26, CD30, CD33, or CD38.

In some embodiments, the ASBD is an Avimer scaffold-based AD binding domain that specifically binds to an AD of human CD45. In some embodiments, the ASBD is an Avimer scaffold-based AD binding domain that specifically binds to an AD of human CD26, CD30, CD33, or CD38.

In some embodiments, the ASBD is a fynomer scaffold-based AD binding domain that specifically binds to an AD of human CD45. In some embodiments, the ASBD is a fynomer scaffold-based AD binding domain that specifically binds to an AD of human CD26, CD30, CD33, or CD38.

In some embodiments, the ASBD is a knottin scaffold-based AD binding domain that specifically binds to an AD of human CD45. In some embodiments, the ASBD is a fynomer scaffold-based AD binding domain that specifically binds to an AD of human CD26, CD30, CD33, or CD38.

In some embodiments, the ASBD is a Kunitz scaffold-based AD binding domain that specifically binds to an AD of human CD45. In some embodiments, the ASBD is a Kunitz scaffold-based AD binding domain that specifically binds to an AD of human CD26, CD30, CD33, or CD38.

In some embodiments, the ASBD is a WW domain-based AD binding domain that specifically binds to an AD of human CD45. In some embodiments, the ASBD is a WW domain-based AD binding domain that specifically binds to an AD of human CD26, CD30, CD33, or CD38.

Provided herein are multi-domain soluble Adapter proteins. The Adapter comprises an antigenic determinant (AD) (e.g., as described in Section II) and an antigenic determinant binding domain (ADBD) (e.g., as described in Section III). The Adapter can further comprise additional ADs, additional ADBDs, and/or other additional domains (e.g., as described in Section V). In some embodiments, the Adapter comprises an antigenic determinant binding domain (ADBD) that specifically binds to a human CD45 AD. In some embodiments, the Adapter comprises an antigenic determinant binding domain (ADBD) that specifically binds to an AD of human CD26, CD30, CD33, or CD38.

In some embodiments, the Adapter comprises an AD that is a human CD45 AD. In some embodiments, the Adapter comprises an AD that is an AD of human CD26, CD30, CD33, or CD38.

In some embodiments, The AD in the Adapter is an epitope of human CD45. In some embodiments, The AD in the Adapter is an epitope of the extracellular domain (ECD) of human CD45. In some embodiments, The AD in the Adapter is an epitope of the ECD of human CD45RA. In some embodiments, The AD in the Adapter is an epitope of the ECD of human CD45RB. In some embodiments, The AD in the Adapter is an epitope of the ECD of human CD45RAB. In some embodiments, The AD in the Adapter is an epitope of the ECD of human CD45RBC. In some embodiments, The AD in the Adapter is an epitope of the ECD of human CD45RAC. In some embodiments, The AD in the Adapter is an epitope of the ECD of human CD45RABC. In some embodiments, The AD in the Adapter is an epitope of the ECD of human CD45RO. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1106. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1107. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1108. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1109. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1110. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1111. In further embodiments, The AD in the Adapter comprises 5-25, 5-50, 5-75, 5-100, 5-125, or 5-150 amino acid residues, more than 150 amino acid residues, or all of the amino acid residues of SEQ ID NO: 1112.

In some embodiments, The AD in the Adapter is a glycosylation dependent epitope of human CD45.

In some embodiments, The AD in the Adapter is an epitope of human CD45 that is not present in a non-human primate CD45. In some embodiments, The AD in the Adapter is an epitope of human CD45 that is not present in a rhesus CD45. In some embodiments, The AD in the Adapter is an epitope of human CD45 that is not present in a cynomolgus CD45.

In some embodiments, The AD in the Adapter is an epitope of human CD45 that is bound by the UCHL-1, A6, or ODP4 antibody. In some embodiments, The AD in the Adapter is an epitope of human CD45 that is bound by the 4KB5, MB1, KiB3, 2H4, or MT2 antibody.

In some embodiments, The AD in the Adapter is an epitope of human CD26, CD30, CD33, or CD38.

In some embodiments, the ADBD in the Adapter specifically binds to an AD of human CD45. In some embodiments, the ADBD in the Adapter specifically binds to an AD of the extracellular domain (ECD) of human CD45. In some embodiments, the ADBD in the Adapter specifically binds to an AD of the ECD of human CD45RA. In some embodiments, the ADBD in the Adapter specifically binds to an AD of the ECD of human CD45RB. In some embodiments, the ADBD in the Adapter specifically binds to an AD of the ECD of human CD45RAB. In some embodiments, the ADBD in the Adapter specifically binds to an AD of the ECD of human CD45RBC. In some embodiments, the ADBD in the Adapter specifically binds to an AD of the ECD of human CD45RAC. In some embodiments, the ADBD in the Adapter specifically binds to an AD of the ECD of human CD45RABC. In some embodiments, the ADBD in the Adapter specifically binds to an AD of the ECD of human CD45RO. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1106. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1107. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1108. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1109. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1110. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1111. In some embodiments, the ADBD in the Adapter specifically binds to an AD of comprising 5-25, 5-50, 5-75, 5-100, 5-125, or 5-150 amino acid residues, more than 150 amino acid residues, or all of the amino acid residues of SEQ ID NO: 1112.

In some embodiments, the ADBD in the Adapter specifically binds to a glycosylation dependent epitope of human CD45.

In some embodiments, the ADBD in the Adapter specifically binds to an epitope of human CD45 that is not present in a non-human primate CD45. In some embodiments, the ADBD in the Adapter specifically binds to an epitope of human CD45 that is not present in a rhesus CD45. In some embodiments, the ADBD in the Adapter specifically binds to of human CD45 that is not present in a cynomolgus CD45.

In some embodiments, the ADBD in the Adapter specifically binds to the same epitope of human CD45 that is bound by the UCHL-1, A6, or ODP4 antibody. In some embodiments, the ADBD in the Adapter specifically binds to the same epitope of human CD45 that is bound by the 4KB5, MB1, KiB3, 2H4, or MT2 antibody.

In some embodiments, the ADBD in the Adapter specifically binds to an epitope of human CD45 that overlaps with the epitope bound by the UCHL-1, A6, or ODP4 antibody. In some embodiments, the ADBD in the Adapter specifically binds to an epitope of human CD45 that overlaps with the epitope bound by the 4KB5, MB1, KiB3, 2H4, or MT2 antibody.

In some embodiments, the ADBD in the Adapter competes with a reference antibody for binding to human CD45 in an in vitro binding assay, wherein the reference antibody is UCHL-1, A6, or ODP4. In some embodiments, the ADBD in the Adapter competes with a reference antibody for binding to human CD45 in an in vitro binding assay, wherein the reference antibody is 4KB5, MB1, KiB3, 2H4, or MT2.

In some embodiments, the ADBD in the Adapter specifically binds to an epitope of human CD26, CD30, CD33, or CD38.

In some embodiments, an ADBD in the Adapter can be an antibody, an antigen-binding fragment thereof, a ScFv, an alternative scaffold binding domain, a D domain, a T cell receptor, or an antigen-binding fragment thereof that specifically binds to a human CD45 AD. In some embodiments, an ADBD in the Adapter can be an antibody, an antigen-binding fragment thereof, a ScFv, an alternative scaffold binding domain, a D domain, a T cell receptor, or an antigen-binding fragment thereof that specifically binds to an AD of human CD26, CD30, CD33, or CD38.

In some embodiments, the Adapter is bispecific. In some embodiments, the Adapter comprises an ADBD that binds to a CD45 AD and an ADBD that binds to a second AD. In some embodiments, the Adapter comprises an ADBD that binds to a first CD45 AD and an ADBD that binds to a second CD45 AD.

As provided herein, chimeric antigen receptors (CARs) are multi-domain proteins that comprise an extracellular domain comprising an ADBD, a transmembrane domain, and an intracellular signaling domain (e.g., as described in Section VI).

In some embodiments, the ADBD in the CAR specifically binds to an AD of human CD45. In some embodiments, the ADBD in the CAR specifically binds to an AD of the extracellular domain (ECD) of human CD45. In some embodiments, the ADBD in the CAR specifically binds to an AD of the ECD of human CD45RA. In some embodiments, the ADBD in the CAR specifically binds to an AD of the ECD of human CD45RB. In some embodiments, the ADBD in the CAR specifically binds to an AD of the ECD of human CD45RAB. In some embodiments, the ADBD in the CAR specifically binds to an AD of the ECD of human CD45RBC. In some embodiments, the ADBD in the CAR specifically binds to an AD of the ECD of human CD45RAC. In some embodiments, the ADBD in the CAR specifically binds to an AD of the ECD of human CD45RABC. In some embodiments, the ADBD in the CAR specifically binds to an AD of the ECD of human CD45RO. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1106. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1107. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1108. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1109. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1110. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1111. In some embodiments, the ADBD in the CAR specifically binds to an AD of comprising 5-25, 5-50, 5-75, 5-100, 5-125, or 5-150 amino acid residues, more than 150 amino acid residues, or all of the amino acid residues of SEQ ID NO: 1112.

In some embodiments, the ADBD in the CAR specifically binds to a glycosylation dependent epitope of human CD45.

In some embodiments, the ADBD in the CAR specifically binds to an epitope of human CD45 that is not present in a non-human primate CD45. In some embodiments, the ADBD in the CAR specifically binds to an epitope of human CD45 that is not present in a rhesus CD45. In some embodiments, the ADBD in the CAR specifically binds to of human CD45 that is not present in a cynomolgus CD45.

In some embodiments, the ADBD in the CAR specifically binds to the same epitope of human CD45 that is bound by the UCHL-1, A6, or ODP4 antibody. In some embodiments, the ADBD in the CAR specifically binds to the same epitope of human CD45 that is bound by the 4KB5, MB1, KiB3, 2H4, or MT2 antibody.

In some embodiments, the ADBD in the CAR specifically binds to an epitope of human CD45 that overlaps with the epitope bound by the UCHL-1, A6, or ODP4 antibody. In some embodiments, the ADBD in the CAR specifically binds to an epitope of human CD45 that overlaps with the epitope bound by the 4KB5, MB1, KiB3, 2H4, or MT2 antibody.

In some embodiments, the ADBD in the CAR competes with a reference antibody for binding to human CD45 in an in vitro binding assay, wherein the reference antibody is UCHL-1, A6, or ODP4. In some embodiments, the ADBD in the CAR competes with a reference antibody for binding to human CD45 in an in vitro binding assay, wherein the reference antibody is 4KB5, MB1, KiB3, 2H4, or MT2.

In some embodiments, the ADBD in the CAR specifically binds to an AD of CD26. In further embodiments, the AD comprises 5-25, 5-50, 5-75, 5-100, 5-125, or 5-150 amino acid residues, more than 150 amino acid residues, or all of the amino acid residues of residues 29-766 of SEQ ID NO: 1113.

In some embodiments, the ADBD in the CAR specifically binds to an AD of CD30. In further embodiments, the AD comprises 5-25, 5-50, 5-75, 5-100, 5-125, or 5-150 amino acid residues, more than 150 amino acid residues, or all of the amino acid residues of residues 19-379 of SEQ ID NO: 1114.

In some embodiments, the ADBD in the CAR specifically binds to an AD of CD33. In further embodiments, the AD comprises 5-25, 5-50, 5-75, 5-100, 5-125, or 5-150 amino acid residues, more than 150 amino acid residues, or all of the amino acid residues of residues 18-259 of SEQ ID NO: 1115.

In some embodiments, the ADBD in the CAR specifically binds to an AD of CD38. In further embodiments, the AD comprises 5-25, 5-50, 5-75, 5-100, 5-125, or 5-150 amino acid residues, more than 150 amino acid residues, or all of the amino acid residues of residues 43-300 of SEQ ID NO: 1116.

In some embodiments, a CAR provided herein comprises an ABDB that specifically binds to an AD of human CD45. In some embodiments, a CAR provided herein comprises an ABDB that specifically binds to an AD of human CD26, CD30, CD33, or CD38. In some embodiments, a CAR provided herein comprises an ABDB that specifically binds to AFP p26, or a variant thereof (e.g., a polypeptide comprising the amino acid sequence of SEQ ID NO: 16, 1117, 1118, 1119, 1120, 1121, 1122, or 1123).

To avoid or reduce the possibility that CAR cells disclosed herein target an immune response (e.g., kill) to themselves, a CAR cell can be genetically modified to reduce or eliminate the expression of one or more AD targeted by the CAR cell directly by a CAR described herein or indirectly through an Adaptor described herein. For example, a CAR cell disclosed herein with an ADBD that specifically binds to an AD of human CD45 or a CAR cell disclosed herein suited to be used in combination with an Adapter comprising an ADBD that specifically binds to an AD of human CD45 can be engineered to reduce or eliminate the expression of the human CD45 AD recognized by the ADBD. In some embodiments, the CAR cell is a human immune effector cell.

In some embodiments, the CAR cell comprises a genetic modification that reduces or eliminates the expression of one AD bound by a CAR or Adapter disclosed herein. In some embodiments, the CAR cell comprises a genetic modification that reduces or eliminates the expression of more than one AD bound by a CAR or Adapter disclosed herein. In some embodiments, the CAR cell comprises more than one genetic modification that reduces or eliminates the expression of more than one AD bound by a CAR or Adapter disclosed herein. In some embodiments, the more than one AD is comprised by a single antigen. In some embodiments, the AD is a human CD45 AD. In some embodiments, the CAR cell is a human immune effector cell.

In some embodiments, the genetic modification reduces expression of the AD by about 50%, about 60%, about 70%, about 80%, about 90%, about 95% compared to a reference cell without the genetic modification. In some embodiments, the genetic modification eliminates expression of the AD.

In some embodiments, the genetic modification reduces expression of the polypeptide comprising the AD by about 50%, about 60%, about 70%, about 80%, about 90%, about 95% compared to a reference cell without the genetic modification. In some embodiments, the genetic modification eliminates expression of the polypeptide comprising the AD. In some embodiments, the AD is a human CD45 AD.

In some embodiments, the genetic modification is a deletion, insertion, or substitution in a gene or fragment thereof encoding the AD. In some embodiments, the genetic modification is a deletion, insertion, or substitution in a gene or fragment thereof encoding the AD that eliminates expression of the AD. In some embodiments, the AD is a human CD45 AD.

In some embodiments, the genetic modification is a substitution of a gene or fragment thereof encoding a polypeptide comprising the AD with a nucleotide sequence encoding a homologue, variant, or derivative of the polypeptide comprising the AD, wherein the encoded homologue, variant, or derivative does not comprise the AD. In some embodiments, the homologue is a non-human primate homologue. In some embodiments, the homologue is derived from rhesus macaque. In some embodiments, the homologue is derived from cynomolgus monkey. In some embodiments, the variant is a naturally occurring variant. In some embodiments, the variant is a splice variant. In some embodiments, the variant has altered glycosylation pattern. In some embodiments, the variant or derivative is capable of signaling. In some embodiments, the AD is a human CD45 AD.

The genetic modification can reduce or eliminate the expression of any AD for which it is desirable for a CAR or an Adapter to bind, e.g., any of the ADs described in Section IIa.

In some embodiments, the genetic modification reduces or eliminates the expression of a human CD45 AD. In some embodiments, the AD is an epitope of the extracellular domain (ECD) of human CD45. In some embodiments, the AD is an epitope of the ECD of human CD45RA. In some embodiments, the AD is an epitope of the ECD of human CD45RB. In some embodiments, the AD is an epitope of the ECD of human CD45RAB. In some embodiments, the AD is an epitope of the ECD of human CD45RBC. In some embodiments, the AD is an epitope of the ECD of human CD45RAC. In some embodiments, the AD is an epitope of the ECD of human CD45RABC. In some embodiments, the AD is an epitope of the ECD of human CD45RO. In further embodiments, the AD comprises 5-25, 5-50, 5-75, 5-100, 5-125, or 5-150 amino acid residues, more than 150 amino acid residues, or all of the amino acid residues of SEQ ID NO: 1106. In further embodiments, the AD comprises 5-25, 5-50, 5-75, 5-100, 5-125, or 5-150 amino acid residues, more than 150 amino acid residues, or all of the amino acid residues of SEQ ID NO: 1107. In further embodiments, the AD comprises 5-25, 5-50, 5-75, 5-100, 5-125, or 5-150 amino acid residues, more than 150 amino acid residues, or all of the amino acid residues of SEQ ID NO: 1108. In further embodiments, the AD comprises 5-25, 5-50, 5-75, 5-100, 5-125, or 5-150 amino acid residues, more than 150 amino acid residues, or all of the amino acid residues of SEQ ID NO: 1109. In further embodiments, the AD comprises 5-25, 5-50, 5-75, 5-100, 5-125, or 5-150 amino acid residues, more than 150 amino acid residues, or all of the amino acid residues of SEQ ID NO: 1110. In further embodiments, the AD comprises 5-25, 5-50, 5-75, 5-100, 5-125, or 5-150 amino acid residues, more than 150 amino acid residues, or all of the amino acid residues of SEQ ID NO: 1111. In further embodiments, the AD comprises 5-25, 5-50, 5-75, 5-100, 5-125, or 5-150 amino acid residues, more than 150 amino acid residues, or all of the amino acid residues of SEQ ID NO: 1112.

In some embodiments, the genetic modification reduces or eliminates the expression of a human CD45 AD that is a glycosylation dependent epitope of human CD45.

In some embodiments, the genetic modification reduces or eliminates the expression of a human CD45 AD. In some embodiments, the AD is an epitope of human CD45 that is not present in a non-human primate CD45. In some embodiments, the AD is an epitope of human CD45 that is not present in a rhesus CD45. In some embodiments, the AD is an epitope of human CD45 that is not present in a cynomolgus CD45.

In some embodiments, the genetic modification reduces or eliminates the expression of a human CD45 AD. In some embodiments, the AD is an epitope of human CD45 that is bound by the UCHL-1, A6, or ODP4 antibody. In some embodiments, the AD is an epitope of human CD45 that is bound by the 4KB5, MB1, KiB3, 2H4, or MT2 antibody.

In some embodiments, the genetic modification reduces or eliminates the expression of a human CD45 AD. In some embodiments, the genetic modification is a deletion, insertion, or substitution in a gene or fragment thereof encoding human CD45. In some embodiments, the genetic modification is a deletion, insertion, or substitution in a gene or fragment thereof encoding human CD45 that eliminates expression of the CD45 AD.

In some embodiments, the genetic modification reduces or eliminates the expression of a human CD45 AD. In some embodiments, the genetic modification is a substitution of a gene or fragment thereof encoding human CD45 with a nucleotide sequence encoding a homologue, variant, or derivative of human CD45, wherein the encoded homologue, variant, or derivative does not comprise the human CD45 AD. In some embodiments, the homologue is a non-human primate homologue. In some embodiments, the homologue is rhesus macaque CD45. In some embodiments, the homologue is cynomolgus CD45. In some embodiments, the variant is a naturally occurring variant of human CD45. In some embodiments, the CD45 variant is a splice variant. In some embodiments, the CD45 variant has altered glycosylation pattern. In some embodiments, the variant or derivative is capable of signaling.

In some embodiments, the genetic modification reduces or eliminates the expression of a human CD26, CD30, CD33, or CD38, AD. In some embodiments, the genetic modification reduces or eliminates the expression of human CD26, CD30, CD33, or CD38. In some embodiments, the genetic modification eliminates the expression of human CD26, CD30, CD33, or CD38. In some embodiments, the genetic modification is a substitution of a gene or fragment thereof encoding human CD26, CD30, CD33, or CD38 with a nucleotide sequence encoding a homologue, variant, or derivative of CD26, CD30, CD33, or CD38, wherein the homologue, variant, or derivative does not comprise the AD targeted by a CAR or Adapter described herein.

The production of CAR cells comprising a genetic modification, useful in practicing the provided methods, may be carried out using a variety of standard techniques for recombinant DNA methodologies, genetic manipulation, and genome editing known in the art. Genetically modified CAR cells described herein that lack expression of an AD can routinely be obtained using any suitable means known in the art, including for example, siRNA, shRNA, CRISPR, TALEN, and/or ZFN. Methods for genetic manipulation of CAR cells is described, for example, in U.S. Patent Appl. Pub. 20170204372, which is incorporated herein by reference in its entirety.

Described herein are methods of use comprising contacting a target cell with a CAR cell (e.g., as described above in Section VII) and an Adapter (e.g., as described above in Section V) or a composition (e.g., as described above in Section VIII). In some embodiments, the target cell expresses CD45. In some embodiments the CAR or Adapter comprises an ADBD that specifically binds to a CD45 AD. In some embodiments, the CAR cell comprises a genetic modification that reduces or eliminates the expression of an AD described herein. In some embodiments, the CAR cell comprises a genetic modification that reduces or eliminates the expression of a human CD45 AD.

For example, in one embodiment, a method of delivering an immune response to a target cell comprises contacting the target cell with any of the compositions described herein (e.g., as described in Section VIII). In another embodiment, a method of killing a target cell comprises contacting the target cell with any of the compositions described herein (e.g., as described in Section VIII). As used herein, "contacting" can refer to contacting a target cell in vitro (e.g., in a cell culture) or contacting a target cell in vivo (e.g., in a patient). In some embodiments, the CAR cell comprises a genetic modification that reduces or eliminates the expression of an AD described herein. In some embodiments, the CAR cell comprises a genetic modification that reduces or eliminates the expression of a human CD45 AD. In some embodiments, the target cell expresses CD45.

In the methods of killing a target cell provided herein, the target cell can be a cell of the immune system. In some embodiments, the target cell is a B cell. In some embodiments, the target cell is a T cell. In some embodiments, the target cell is a naïve T cell. In some embodiments, the target cell is a memory T cell. In some embodiments, the target cell is a memory T cell expressing CD45RO.

In some embodiments, the target cell expresses CD45. In some embodiments, the target cell expresses CD45RO. In some embodiments, the target cell expresses CD45RA. In some embodiments, the target cell expresses CD45RAB. In some embodiments, the target cell expresses CD45RAC. In some embodiments, the target cell expresses CD45RBC. In some embodiments, the target cell expresses CD45RABC. In some embodiments, the CD45 is human CD45.

In some embodiments of the compositions and methods disclosed herein, the target is an antigenic determinant of human CD45. In some embodiments, the target is an antigenic determinant of human CD45R, CD45RA, CD45RB, or CD45RO. In some embodiments, the target is an antigenic determinant of human CD45 that is not present in a non-human primate homologue of CD45. In some embodiments, the target is an antigenic determinant of human CD45R, CD45RA, CD45RB, or CD45RO that is not present in a non-human primate homologue of CD45. In some embodiments, the target is an antigenic determinant of human CD45 that is not present in rhesus or cynomolgus CD45. In some embodiments, the target is an antigenic determinant of human CD26, CD30, CD33, or CD38. In some embodiments, the target is an antigenic determinant of human CD26, CD30, CD33, or CD38 that is not present in a non-human primate homologue of CD26, CD30, CD33, or CD38, respectively. In some embodiments, the target is an antigenic determinant of human CD26, CD30, CD33, or CD38 that is not present in rhesus or cynomolgus CD26, CD30, CD33, or CD38, respectively.

In some embodiments of the compositions and methods disclosed herein, the target cell can be a cell expressing CD45. In some embodiments, a target cell can be a cell expressing CD45R, CD45RA, CD45RB, or CD45RO. In some embodiments, a target cell can be a cell expressing CD26, CD30, CD33, or CD38.

Described herein are methods of delivering an immune response to a target cell in a patient and/or killing a target cell in a patient comprising administering an Adapter (as described herein (e.g., as described in Section V above)) and/or a CAR cell described herein (e.g., as described in Section VII) to the patient. Also described herein are methods of treating a proliferative disorder, cancer, autoimmune disease, infection, or allograft rejection comprising administering an Adapter described herein (e.g., as described in Section V) and/or a CAR cell described herein (e.g., as described in Section VII) to the patient. In particular embodiments, provided herein are methods of treating hematological cancer or autoimmune disease comprising administering an Adapter described herein (e.g., as described in Section V) and/or a CAR cell described herein (e.g., as described in Section VII) to the patient. In some embodiments, the target cell expresses CD45. In some embodiments the CAR or Adapter comprises an ADBD that specifically binds to a CD45 AD. In some embodiments, the CAR cell comprises a genetic modification that reduces or eliminates the expression of an AD described herein. In some embodiments, the CAR cell comprises a genetic modification that reduces or eliminates the expression of a CD45 AD.

In one embodiment of the methods of killing a target cell in a patient or the methods of redirecting target cell killing in a patient, the target cell is a cell of the immune system. In some embodiments, the target cell is a B cell. In some embodiments, the target cell is a T cell. In some embodiments, the target cell is a naïve T cell. In some embodiments, the target cell is a memory T cell. In some embodiments, the target cell is a memory T cell expressing CD45RO.

In some embodiments, the target cell expresses CD45. In some embodiments, the target cell expresses CD45RO. In some embodiments, the target cell expresses CD45RA. In some embodiments, the target cell expresses CD45RAB. In some embodiments, the target cell expresses CD45RAC. In some embodiments, the target cell expresses CD45RBC. In some embodiments, the target cell expresses CD45RABC. In some embodiments, the CD45 is human CD45.

In one embodiment of the methods of killing a target cell in a patient or the methods of redirecting target cell killing in a patient, the patient has been diagnosed with an autoimmune disease or disorder and the target cell is a cell of the immune system expressing a CD45 AD. In some embodiments, the target cell is a B cell. In some embodiments, the target cell is a T cell. In some embodiments, the target cell is a memory T cell. In some embodiments, the target cell expresses CD45. In some embodiments, the target cell expresses CD45RO.

In one embodiment, the methods described herein are useful for preparing or conditioning a patient for bone marrow transplantation (BMT) or hematopoietic stem cell transplantation (HSCT). Thus in some embodiments, the methods of killing a target cell in a patient or the methods of redirecting target cell killing in a patient provided herein condition a subject for BMT or HSCT. In some embodiments, the methods provided herein condition a subject for HSCT. In some embodiments, the HSCT is autologous HSCT. In some embodiments, the methods for conditioning a patient disclosed herein does not comprise high dose chemotherapy or total body irradiation (TBI). In some embodiments, the methods for conditioning disclosed herein comprise reduced intensity chemotherapy. In some embodiments, the methods for conditioning disclosed herein comprise total body irradiation. In some embodiments, the patient is more than 65 years old. In some embodiments, the patient has cancer. In some embodiments, the patient has a hematologic cancer. In some embodiments, the patient has a relapsed hematologic cancer. In some embodiments, the hematologic cancer is acute myeloid leukemia (AML), chronic lymphocytic leukemia (CLL), or multiple myeloma (MM). In some embodiments, the patient has an autoimmune disease or disorder. In some embodiments, the autoimmune disease or disorder is Type I diabetes, multiple sclerosis, rheumatoid arthritis, inflammatory bowel disease (IBD), Crohn's disease, or ulcerative.

In one embodiment of the methods of conditioning a patient for HSCT the patient has been diagnosed with a hematologic cancer and the target cell is a cell expressing a CD45 AD. In some embodiments, the patient is administered an engineered human immune effector cell comprising (i) a chimeric antigen receptor (CAR) comprising (1) an antigenic determinant binding domain (ADBD) that specifically binds to a human CD45 antigenic determinant (AD), (2) a transmembrane domain, and (3) an intracellular domain; and (ii) a genetic modification that eliminates the expression of the human CD45 AD on the engineered cell. In some embodiments, the patient is administered an engineered human immune effector cell comprising (i) a chimeric antigen receptor (CAR) comprising an antigenic determinant binding domain (ADBD) that specifically binds to a human CD45 antigenic determinant (AD; and (ii) a genetic modification that eliminates the expression of the human CD45 AD on the engineered cell. In some embodiments, the patient is administered an (a) engineered human immune effector cell comprising (i) a chimeric antigen receptor (CAR) comprising a first antigenic determinant binding domain (ADBD) that specifically binds to a first antigenic determinant (AD), and (ii) a genetic modification that eliminates the expression of at least one human CD45 AD on the engineered cell and (b) an Adapter comprising the first AD and a second ADBD that specifically binds to a human CD45 AD.

Articles of manufacture, including kits containing the Adapter, CAR cell, and/or CAR cell/Adapter compositions, are provided herein. The article of manufacture may comprise a container and a label or package insert on or associated with the container. Suitable containers include, for example, bottles, vials or syringes. The containers may be formed from a variety of materials such as glass or plastic. The container holds one or more Adapter, CAR cell, nucleic acids encoding Adapter, and/or vectors or host cells of the present disclosure. The label or package insert may include directions for administering the Adapter, CAR cell, and/or CAR cell/Adapter compositions to a patient. Such kits have uses including, but not limited to, therapeutic applications of the Adapter, CAR cell, and/or CAR/Adapter compositions. In some embodiments, the CAR comprises an ADBD that specifically binds to a CD45 AD. In some embodiments, the Adapter comprises an ADBD that specifically binds to a CD45 AD. In some embodiments, the CAR cell comprises a genetic modification that reduces or eliminates the expression of a CD45 AD.

Various embodiments of the invention will now be illustrated through the description of experiments in accordance therewith. The examples that follow are provided to facilitate the practice of the disclosed embodiments, and are not to be construed as limiting in any way the remainder of the disclosure. In the examples, reference is made to the appended figures.

EXAMPLES

Example 1. Exemplary D Domains and ADs

TABLE 3

Exemplary D-domains

| SEQ ID NO: | D-Domain Sequence | Target | ELISA_avg |
|---|---|---|---|
| 44 | MGSWYEFSWRLQAIHQRLNALGGSEAELAAFEKEIAAFESELQAYKGKGNPEVEELRAYAAGIRGALQAYRHN | BCMA | 9.4868 |
| 45 | MGSWHEFTWRLIAIQQRLEALGGSEAELAAFEKEIAAFESELQAYKGKGNPEVEELRAYAAGIRHHLQAYRHN | BCMA | 17.125 |
| 46 | MGSWREFAWRLVAINSRLKALGGSEAELAAFEKEIAAFESELQAYKGKGNPEVEELRHYAASIRDGLQAYRHN | BCMA | 9.66 |
| 47 | MGSWHEFAWRLQAINQRLNALGGSEAELAAFEKEIAAFESELQAYKGKGNPEVEELRHYAAHIRNGLQAYRHN | BCMA | 13.14 |
| 48 | MGSWNEFAWRLTAIEQRLMALGGSEAELAAFEKEIAAFESELQAYKGKGNPEVEELRHYAAGIRDNLQAYRHN | BCMA | 18.28 |
| 49 | MGSWTEFAWRLQAIHQRLQALGGSEAELAAFEKEIAAFESELQAYKGKGNPEVEELRVYAAKIRISLQAYRHN | BCMA | 18.71 |
| 50 | MGSWIEFAWRLQAIHQRLDALGGSEAELAAFEKEIAAFESELQAYKGKGNPEVEDLREYAANIRDSLQAYRHN | BCMA | 18.97 |
| 51 | MGSWHEFTWRLVAIQQRLQALGGSEAELAAFEKEIAAFESELQAYKGKGNPEVEELRKFAAKIRYELQAYRHN | BCMA | 19.51 |
| 52 | MGSWHEFTWRLIAIRERLFALGGSEAELAAFEKEIAAFESELQAYKGKGNPEVEELREYAASIRNMLQAYRHN | BCMA | 12.99 |
| 53 | MGSWIEFSWRLEAIRQRLQALGGSEAELAAFEKEIAAFESELQAYKGKGNPEVESLRSYAARIRQELQAYRHN | BCMA | 9.92 |
| 54 | MGSWVEFSWRLEAIRQRLQALGGSEAELAAFEKEIAAFESELQAYKGKGNPEVESLRSYAARIRQELQAYRHN | BCMA | 19.14 |
| 55 | MGSWVEFSWRLEAIRQRLTALGGSEAELAAFEKEIAAFESELQAYKGKGNPEVEDLRKYAARIRGELQAYRHN | BCMA | 21.3 |
| 56 | MGSWVEFAWRLTAIDQRLSALGGSEAELAAFEKEIAAFESELQAYKGKGNPEVENLRFYAAKIRSHLQAYRHN | BCMA | 8.43 |
| 57 | MGSWVEFAWRLEAIKQRLTALGGSEAELAAFEKEIAAFESELQAYKGKGNPEVEELRLYAAKIRRVLQAYRHN | BCMA | 8.9 |
| 58 | MGSWVEFAWRLTAIHTRLWALGGSEAELAAFEKEIAAFESELQAYKGKGNPEVESLRKYAAKIRKQLQAYRHN | BCMA | 6.08 |
| 59 | MGSWTEFAWRLEAINQRLQALGGSEAELAAFEKEIAAFESELQAYKGKGKPEVEALRAYAAKIRTRLQAYRHN | BCMA | 15.148 |
| 60 | MGSWSEFAWRLEAIHQRLSALGGSEAELAAFEKEIAAFESELQAYKGKGNPEVESLRLFAAQIRENLQAYRHN | BCMA | 18.04 |
| 61 | MGSWNEFAWRLIAINQRLWALGGSEAELAAFEKEIAAFESELQAYKGKGNPEVESLRHFAANIRNDLQAYRHN | BCMA | 11.53 |
| 62 | MGSWTEFAWRLIAIDQRLMALGGSEAELAAFEKEIAAFESELQAYKGKGNPEVEILRELAAEIRFHLQAYRHN | BCMA | 8.55 |
| 63 | MGSWSEFMNRLDAITYRLVALGGSEAELAAFEKEIAAFESELQAYKGKGNPEVELLRHYAAQIRDSLQAYRHN | BCMA | 12.9 |
| 64 | MGSWTEFMERLDAISYRLWALGGSEAELAAFEKEIAAFESELQAYKGKGNPEVEVLRDYAAIIRNSLQAYRHN | BCMA | 9.87 |
| 65 | MGSWAEFMDRLDAITYRLWALGGSEAELAAFEKEIAAFESELQAYKGKGNPEVEELRGYAAIIRSELQAYRHN | BCMA | 10.83 |
| 66 | MGSWIEFQERLDAIFYRLHALGGSEAELAAFEKEIAAFESELQAYKGKGNPEVEDLRDAAATIRRQLQAYRHN | BCMA | 18.58 |

TABLE 3-continued

Exemplary D-domains

| SEQ ID NO: | D-Domain Sequence | Target | ELISA_avg |
|---|---|---|---|
| 67 | MGSWIEFQQRLDAIFYRLYALGGSEAELAAFEKEIAAFESELQAYKGKGNPEVENLRDMAAIIRKQLQAYRHN | BCMA | 20.02 |
| 68 | MGSWYEFQSRLDAIFYRLFALGGSEAELAAFEKEIAAFESELQAYKGKGNPEVEKLREAAASIRTQLQAYRHN | BCMA | 14.08 |
| 69 | MGSWSEFIDRLDAITYRLFALGGSEAELAAFEKEIAAFESELQAYKGKGNPEVENLRWYAGVIREQLQAYRHN | BCMA | 10.18 |
| 70 | MGSWSEFYDRLYAINQRLFALGGSEAELAAFEKEIAAFESELQAYKGKGNPEVEDLRWYAAFIRAQLQAYRHN | BCMA | 5.98 |
| 71 | MGSWYEFYDRLDAIVHRLDALGGSEAELAAFEKEIAAFESELQAYKGKGNPEVENLRWYAAMIRVRLQAYRHN | BCMA | 14.68 |
| 72 | MGSWVEFQDRLEAITDRLYALGGSEAELAAFEKEIAAFESELQAYKGKGNPEVEELRYSAAMIRVILQAYRHN | BCMA | 8.8783 |
| 73 | MGSWVEFQERLMAISDRLYALGGSEAELAAFEKEIAAFESELQAYKGKGNPEVEELRWQAAMIRYTLQAYRHN | BCMA | 6.7 |
| 74 | MGSWFEFQHRLEAISMRLHALGGSEAELAAFEKEIAAFESELQAYKGKGNPEVEELRWQAAYIRVVLQAYRHN | BCMA | 4.05 |
| 75 | MGSWVEFQSRLEAIATRLRALGGSEAELAAFEKEIAAFESELQAYKGKGNPEVEELRWQAAWIRMMLQAYRHN | BCMA | 18.008 |
| 76 | MGSWEEFQYRLGAIAARLQALGGSEAELAAFEKEIAAFESELQAYKGKGNPEVEELRWQAAMIRFMLQAYRHN | BCMA | 3.11 |
| 77 | MGSWYEFQVRLQAISWRLKALGGSEAELAAFEKEIAAFESELQAYKGKGNHEVEELRIQAALIRVMLQAYRHN | BCMA | 14.23 |
| 78 | MGSWVEFRSRLEAISNRLRALGGSEAELAAFEKEIAAFESELQAYKGKGNPEVEELRTTAALIRVYLQAYRHN | BCMA | 3.04 |
| 79 | MGSWVEFKARLEAISSRLTALGGSEAELAAFEKEIAAFESELQAYKGKGNPEVEELRYSAALIRVYLQAYRHN | BCMA | 8.7071 |
| 80 | MGSWSEFYTRLEAINNRLHALGGSEAELAAFEKEIAAFESELQAYKGKGNPEVEELRYTAALIRIYLQAYRHN | BCMA | 3.66 |
| 81 | MGSWAEFYHRLDAISSRLRALGGSEAELAAFEKEIAAFESELQAYKGKGNPEVEELRYTAALIRIYLQAYRHN | BCMA | 4.31 |
| 82 | MGSWTEFASRLVAIRQRLQALGGSEAELAAFEKEIAAFESELQAYKGKGNPEVEELRYSAAIIRVMLQAYRHN | BCMA | 7.99 |
| 83 | MGSWSEFDQRLAAIYQRLNALGGSEAELAAFEKEIAAFESELQAYKGKGNPEVEELRYSAALIRVMLQAYRHN | BCMA | 7.72 |
| 84 | MGSWVEFHNRLSAISDRLGALGGSEAELAAFEKEIAAFESELQAYKGKGNPEVEELRYSAALIRVMLQAYRHN | BCMA | 7.36 |
| 85 | MGSWNEFEDRLSAISARLSALGGSEAELAAFEKEIAAFESELQAYKGKGNPEVEELRYSAALIRVMLQAYRHN | BCMA | 4.09 |
| 86 | MGSWVEFEYRLVAIFDRLQALGGSEAELAAFEKEIAAFESELQAYKGKGNPEVEELRYQAALIRVMLQAYRHN | BCMA | 7.63 |
| 87 | MGSWVEFQGRLGAIHERLQALGGSEAELAAFEKEIAAFESELQAYKGKGNPEVEELRYSAALIRVFLQAYRHN | BCMA | 3.8343 |
| 88 | MGSWYEFSMRLSAIWERLHALGGSEAELAAFEKEIAAFESELQAYKGKGNPEVEELRYQAALIRFYLQAYRHN | BCMA | 7.12 |
| 89 | MGSWTEFSQRLGAISERLYALGGSEAELAAFEKEIAAFESELQAYKGKGNPEVEELRYSAALIRFMLQAYRHN | BCMA | 4.15 |
| 90 | MGSWTEFHDRLEAITHRLNALGGSEAELAAFEKEIAAFESELQAYKGKGNPEVEELRYSAALLRVFLQAYRHN | BCMA | 5.79 |
| 91 | MGSWTEFEHRLEAIAGRLNALGGSEAELAAFEKEIAAFESELQAYKGKGNPEVEELRYSAALIRFWLQAYRHN | BCMA | 6.34 |

TABLE 3-continued

Exemplary D-domains

| SEQ ID NO: | D-Domain Sequence | Target | ELISA_avg |
|---|---|---|---|
| 92 | MGSWTEFANRLEAINARLHALGGSEAELAAFEKEIAAFESELQAYKGKGNPEVEELRFSAALIRVYLQAYRHN | BCMA | 6.42 |
| 93 | MGSWEEFDRRLYAIARRLEALGGSEAELAAFEKEIAAFESELQAYKGKGNPEVEELRYQAALIRVWLQAYRHN | BCMA | 8.85 |
| 94 | MGSWIEFHQRLEAIVTRLEALGGSEAELAAFEKEIAAFESELQAYKGKGNPEVEELRYQAALIRVFLQAYRHN | BCMA | 8 |
| 95 | MGSWSEFYDRLKAIADRLHALGGSEAELAAFEKEIAAFESELQAYKGKGNPEVEELRTEAAIIRVYLQAYRHN | BCMA | 8.215 |
| 96 | MGSWWEFEDRLSAIMERLHALGGSEAELAAFEKEIAAFESELQAYKGKGNPEVEELRYRAAIIRVYLQAYRHN | BCMA | 10.39 |
| 97 | MGSWVEFEERLAAIATRLHALGGSEAELAAFEKEIAAFESELQAYKGKGNPEVEELRWRAAIIRVYLQAYRHN | BCMA | 16.29 |
| 98 | MGSWSEFRGRLQAIHSRLNALGGSEAELAAFEKEIAAFESELQAYKGKGNPEVEELRYSAAIIRIYLQAYRHN | BCMA | 7.585 |
| 99 | MGSWTEFRDRLGAIYHRLDALGGSEAELAAFEKEIAAFESELQAYKGKGNPEVEELRYQAAIIRVYLQAYRHN | BCMA | 6.7 |
| 100 | MGSWVEFYHRLEAIRYRLSALGGSEAELAAFEKEIAAFESELQAYKGKGNPEVEELRYVAAVIRYRLQAYRHN | BCMA | 7.8 |
| 101 | MGSWVEFYDRLEAIRYRLSALGGSEAELAAFEKEIAAFESELQAYKGKGNPEVEELRYIAAVIRYRLQAYRHN | BCMA | 5.636 |
| 102 | MGSWVEFYDRLAAIRKRLYALGGSEAELAAFEKEIAAFESELQAYKGKGNPEVEELRFRAALIRIWLQAYRHN | BCMA | 9.76 |
| 103 | MGSWEEFSERLEAISIRLRALGGSEAELAAFEKEIAAFESELQAYKGKGNPEVEELRVSAAIIRVWLQAYRHN | BCMA | 11.26 |
| 104 | MGSWSEFSDRLHAISDRLQALGGSEAELAAFEKEIAAFESELQAYKGKGNPEVEELRIQAAIIRVWLQAYRHN | BCMA | 6.3725 |
| 105 | MGSWIEFSHRLEAIVDRLGALGGSEAELAAFEKEIAAFESELQAYKGKGNPEVEELRNTAAIIRVYLQAYRHN | BCMA | 18.67 |
| 106 | MGSWEEFSDRLEAILRRLDALGGSEAELAAFEKEIAAFESELQAYKGKGNPEVEDLRFAAAIIRVQLQAYRHN | BCMA | 9.08 |
| 107 | MGSWMEFSHRLDAIHERLYALGGSEAELAAFEKEIAAFESELQAYKGKGNPEVEDLRFAAAIIRVQLQAYRHN | BCMA | 6.3 |
| 108 | MGSWSEFQQRLHAIRTRLYALGGSEAELAAFEKEIAAFESELQAYKGKGNPEVEELRFEAAIIRVMLQAYRHN | BCMA | 11.615 |
| 109 | MGSWYEFQNRLGAINRRLNALGGSEAELAAFEKEIAAFESELQAYKGKGNPEVEELRFEAAIIRVMLQAYRHN | BCMA | 4.68 |
| 110 | MGSWQEFTGRLHAIRHRLEALGGSEAELAAFEKEIAAFESELQAYKGKGNPEVEELRFEAAYIRVWLQAYRHN | BCMA | 3.315 |
| 111 | MGSWTEFDHRLGAIWERLVALGGSEAELAAFEKEIAAFESELQAYKGKGNPEVEELRFHAAIIRIFLQAYRHN | BCMA | 9.54 |
| 112 | MGSWTEFHVRLSAIWDRLVALGGSEAELAAFEKEIAAFESELQAYKGKGNPEVEELRFHAAIIRIVLQAYRHN | BCMA | 23.62 |
| 113 | MGSWNEFDNRLQAIWDRLHALGGSEAELAAFEKEIAAFESELQAYKGKGNPEVEELRFHAAMIRITLQAYRHN | BCMA | 9.87 |
| 114 | MGSWTEFHERLQAIWFRLHALGGSEAELAAFEKEIAAFESELQAYKGKGNPEVEELRFRAAIIRLYLQAYRHN | BCMA | 12.066 |
| 115 | MGSWNEFSGRLTAIKDRLAALGGSEAELAAFEKEIAAFESELQAYKGKGNPEVEELRFRAAVIRLWLQAYRHN | BCMA | 3.39 |
| 116 | MGSWVEFDERLVAIWFRLHALGGSEAELAAFEKEIAAFESELQAYKGKGNPEVEALRARAAYIRIWLQAYRHN | BCMA | 8.96 |

TABLE 3-continued

Exemplary D-domains

| SEQ ID NO: | D-Domain Sequence | Target | ELISA_avg |
|---|---|---|---|
| 117 | MGSWSEFGQRLSAIWERLLALGGSEAELAAFEKEIAAFESELQAYKGKGNPEVEALRADAAFIRIWLQAYRHN | BCMA | 14.01 |
| 118 | MGSWYEFEDRLVAIWIRLDALGGSEAELAAFEKEIAAFESELQAYKGKGNPEVEELRYNAAFIRGALQAYRHN | BCMA | 4.93 |
| 119 | MGSWYEFGDRLSAIWERLAALGGSEAELAAFEKEIAAFESELQAYKGKGNPEVEYLRTHAAEIRTILQAYRHN | BCMA | 8.895 |
| 120 | MGSWHEFYYRLEAIEQRLHALGGSEAELAAFEKEIAAFESELQAYKGKGNPEVETLRFDAALIRIYLQAYRHN | BCMA | 3.73 |
| 121 | MGSWSEFEERLAAIGSRLFALGGSEAELAAFEKEIAAFESELQAYKGKGNPEVETLRFDAALIRIYLQAYRHN | BCMA | 4.85 |
| 122 | MGSWLEFHYRLHAIQFRLYALGGSEAELAAFEKEIAAFESELQAYKGKGNPEVETLRHIAALIRNQLQAYRHN | BCMA | 12.749 |
| 123 | MGSWQEFYNRLEAIHMRLFALGGSEAELAAFEKEIAAFESELQAYKGKGNPEVEGLRSDAAPIRDVLQAYRHN | BCMA | 6.47 |
| 124 | MGSWNEFHHRLWAIFDRLGALGGSEAELAAFEKEIAAFESELQAYKGKGNPEVEVLRKMAAGIRGGLQAYRHN | BCMA | 3.88 |
| 125 | MGSWYEFHYRLKAINDRLYALGGSEAELAAFEKEIAAFESELQAYKGKGNPEVEYLRYSAAMIRHKLQAYRHN | BCMA | 6.04 |
| 126 | MGSWTEFHQRLGAIHARLGALGGSEAELAAFEKEIAAFESELQAYKGKGNPEVEYLRFSAAFIRLKLQAYRHN | BCMA | 8.87 |
| 127 | MGSWFEFQYRLEAIFYRLLALGGSEAELAAFEKEIAAFESELQAYKGKGKPEVEELRVRAALIRHLLQAYRHN | BCMA | 17.31 |
| 128 | MGSWVEFHARLDAIYTRLGALGGSEAELAAFEKEIAAFESELQAYKGKGNPEVEYLRVLAAHIRISLQAYRHN | BCMA | 3.8 |
| 129 | MGSWVEFGTRLSAIYNRLWALGGSEAELAAFEKEIAAFESELQAYKGKGNPEVEDLRFEAAIIRIMLQAYRHN | BCMA | 15.425 |
| 130 | MGSWVEFTHRLDAIYIRLWALGGSEAELAAFEKEIAAFESELQAYKGKGNPEVEELRHEAAVIREELQAYRHN | BCMA | 13.917 |
| 131 | MGSWVEFHGRLAAIYVRLFALGGSEAELAAFEKEIAAFESELQAYKGKGNPEVESLRYHAAMIRRNLQAYRHN | BCMA | 4 |
| 132 | MGSWVEFDRRLVAIYIRLWALGGSEAELAAFEKEIAAFESELQAYKGKGNPEVEALRDDAALIRLLLQAYRHN | BCMA | 8.93 |
| 133 | MGSWVEFDRRLVAIYIRLWALGGSEAELAAFEKEIAAFESELQAYKGKGNPEVEKLRYDAATIRETLQAYRHN | BCMA | 8 |
| 134 | MGSWLEFDRRLTAIYLRLWALGGSEAELAAFEKEIAAFESELQAYKGKGNPEVEALREDAAMIRDMLQAYRHN | BCMA | 9.82 |
| 135 | MGSWIEFDRRLLAIHVRLWALGGSEAELAAFEKEIAAFESELQAYKGKGNPEVEVLRADAAKIRMELQAYRHN | BCMA | 13.72 |
| 136 | MGSWIEFDRRLIAIWIRLWALGGSEAELAAFEKEIAAFESELQAYKGKGNPEVESLRSDAADIRQKLQAYRHN | BCMA | 9.45 |
| 137 | MGSWVEFDRRLIAIWVRLWALGGSEAELAAFEKEIAAFESELQAYKGKGNPEVEFLRSDAAMIREHLQAYRHN | BCMA | 5.77 |
| 138 | MGSWYEFHTRLIAIYVRLWALGGSEAELAAFEKEIAAFESELQAYKGKGNPEVEWLRGDAAKIRGYLQAYRHN | BCMA | 4.06 |
| 139 | MGSWSEFSTRLSAIYVRLWALGGSEAELAAFEKEIAAFESELQAYKGKGNPEVEYLRNKAASIRKTLQAYRHN | BCMA | 5.35 |
| 140 | MGSWVEFRYRLGAIYHRLWALGGSEAELAAFEKEIAAFESELQAYKGKGNPEVEVLRDRAATIRRLLQAYRHN | BCMA | 10.81 |
| 141 | MGSWNEFRNRLGAIDSRLWALGGSEAELAAFEKEIAAFESELQAYKGKGNPEVETLRAHAAIIRSVLQAYRHN | BCMA | 4.6967 |

TABLE 3-continued

Exemplary D-domains

| SEQ ID NO: | D-Domain Sequence | Target | ELISA_avg |
|---|---|---|---|
| 142 | MGSWHEFRNRLGAIDSRLWALGGSEAELAAFEKEIAAFESELQAYKGKGNPEVETLRARAAMIRSVLQAYRHN | BCMA | 3.4936 |
| 143 | MGSWTEFYQRLEAINFRLWALGGSEAELAAFEKEIAAFESELQAYKGKGNPEVEVLRDKAALIRLMLQAYRHN | BCMA | 6.955 |
| 144 | MGSWNEFYNRLHAINLRLWALGGSEAELAAFEKEIAAFESELQAYKGKGNPEVEVLREHAAIIRQALQAYRHN | BCMA | 3.004 |
| 145 | MGSWEEFYGRLSAIQDRLWALGGSEAELAAFEKEIAAFESELQAYKGKGNPEVEWLRMHAAVIRRALQAYRHN | BCMA | 3.28 |
| 146 | MGSWGEFNLRLVAIHVRLWALGGSEAELAAFEKEIAAFESELQAYKGKGNPEVEFLRSQAANIRAQLQAYRHN | BCMA | 12.81 |
| 147 | MGSWGEFSDRLEAINERLWALGGSEAELAAFEKEIAAFESELQAYKGKGNPEVEELRWQAAFIRANLQAYRHN | BCMA | 4.26 |
| 148 | MGSWMEFQGRLPAILARLRALGGSEAELAAFEKEIAAFESELQAYKGKGNPEVEHLRDKAAYIRWMLQAYRHN | BCMA | 8.32 |
| 149 | MGSWMEFEGRLPAILARLRALGGSEAELAAFEKEIAAFESELQAYKGKGNPEVEHLRDKAAYIRWMLQAYRHN | BCMA | 3.93 |
| 150 | MGSWFEFQNRLQAILFRLRALGGSEAELAAFEKEIAAFESELQAYKGKGNPEVENLRDKAAYIRLMLQAYRHN | BCMA | 5.3933 |
| 151 | MGSWVEFDMRLQAILERLRALGGSEAELAAFEKEIAAFESELQAYKGKGNPEVEHLRDSAAYIRLMLQAYRHN | BCMA | 23.525 |
| 152 | MGSWVEFNARLDAILFRLRALGGSEAELAAFEKEIAAFESELQAYKGKGNPEVEHLRDQAAYIRLMLQAYRHN | BCMA | 13.52 |
| 153 | MGSWMEFNVRLRAILDRLHALGGSEAELAAFEKEIAAFESELQAYKGKGNPEVELLRDKAAYIRFMLQAYRHN | BCMA | 15.59 |
| 154 | MGSWIEFDTRLAAIVHRLRALGGSEAELAAFEKEIAAFESELQAYKGKGNPEVELLRDKAAYIRYMLQAYRHN | BCMA | 13.948 |
| 155 | MGSWIEFDYRLKAILHRLRALGGSEAELAAFEKEIAAFESELQAYKGKGNPEVEGLRDKAAYIRFLLQAYRHN | BCMA | 11.877 |
| 156 | MGSWYEFEDRLLAIKVRLRALGGSEAELAAFEKEIAAFESELQAYKGKGNPEVEYLRDQAAYIRFMLQAYRHN | BCMA | 17.613 |
| 157 | MGSWYEFQDRLSAITTRLRALGGSEAELAAFEKEIAAFESELQAYKGKGNPEVELLRDKAAYIRFMLQAYRHN | BCMA | 10.085 |
| 158 | MGSWEEFDDRLNAIVYRLRALGGSEAELAAFEKEIAAFESELQAYKGKGNPEVEMLRDQAAYIRLMLQAYRHN | BCMA | 18.64 |
| 159 | MGSWVEFEQRLHAIVVRLRALGGSEAELAAFEKEIAAFESELQAYKGGGNPEVENLRDQAAYIRFMLQAYRHN | BCMA | 17.747 |
| 160 | MGSWVEFEWRLEAIVVRLRALGGSEAELAAFEKEIAAFESELQAYKGKGNPEVEHLRDKAAYIRYMLQAYRHN | BCMA | 14.95 |
| 161 | MGSWYEFEHRLKAIVSRLGALGGSEAELAAFEKEIAAFESELQAYKGKGNPEVEHLRDKAAYIRYMLQAYRHN | BCMA | 4.55 |
| 162 | MGSWMEFKHRLAAITFRLRALGGSEAELAAFEKEIAAFESELQAYKGKGNPEVELLRDKAAYIRLLLQAYRHN | BCMA | 6.06 |
| 163 | MGSWMEFEGRLHAIKRRLRALGGSEAELAAFEKEIAAFESELQAYKGKGNPEVEVLRDQAAYIRLLLQAYRHN | BCMA | 7.335 |
| 164 | MGSWSEFVFRLDTIKSRLRALGGSEAELAAFEKEIAAFESELQAYKGKGNPEVETLRDQAAYIRLMLQAYRHN | BCMA | 19.86 |
| 165 | MGSWYEFDERLSAIKLRLRALGGSEAELAAFEKEIAAFESELQAYKGKGNPEVEVLRAQAAYIRAILQAYRHN | BCMA | 16.94 |
| 166 | MGSWMEFDERLWAIKKRLRALGGSEAELAAFEKEIAAFESELQAYKGKGNPEVEFLRHQAAYIRMLLQAYRHN | BCMA | 9.526 |

TABLE 3-continued

Exemplary D-domains

| SEQ ID NO: | D-Domain Sequence | Target | ELISA_avg |
|---|---|---|---|
| 167 | MGSWHEFDGRLSAIKRRLWALGGSEAELAAFEKEIAAFESELQAYKGKGNPEVEHLRDQAAYIRYMLQAYRHN | BCMA | 5.4 |
| 168 | MGSWYEFDGRLQAIIARLRALGGSEAELAAFEKEIAAFESELQAYKGKGNPEVEHLRFAAYIRWILQAYRHN | BCMA | 3.29 |
| 169 | MGSWFEFDKRLYAIIHRLRALGGSEAELAAFEKEIAAFESELQAYKGKGNPEVEKLRYKAAIIRLYLQAYRHN | BCMA | 11.82 |
| 170 | MGSWVEFDNRLYAIVDRLRALGGSEAELAAFEKEIAAFESELQAYKGKGNPEVEHLRQKAAYIRLILQAYRHN | BCMA | 11.717 |
| 171 | MGSWIEFHQRLNAIFNRLRALGGSEAELAAFEKEIAAFESELQAYKGKGNPEVEWLRHHAAYIREMLQAYRHN | BCMA | 7.3417 |
| 172 | MGSWNEFRLRLWAITERLRALGGSEAELAAFEKEIAAFESELQAYKGKGNPEVECLRAEAAWIRTMLQAYRHN | BCMA | 3.8718 |
| 173 | MGSWYEFWLRLSAISYRLQALGGSEAELAAFEKEIAAFESELQAYKGKGNPEVEWLRKEAAEIRSWLQAYRHN | BCMA | 14.465 |
| 174 | MGSWYEFQLRLWAIHWRLIALGGSEAELAAFEKEIAAFESELQAYKGKGNPEVEWLRMRAAEIRNELQAYRHN | BCMA | 20.59 |
| 175 | MGSWYEFAHRLEAIEWRLIALGGSEAELAAFEKEIAAFESELQAYKGKGNPEVEELRQYAAAIRNYLQAYRHN | BCMA | 9.48 |
| 176 | MGSWYEFDTRLGAIRNRLGALGGSEAELAAFEKEIAAFESELQAYKGKGNPEVEWLRFQAAYIRFLLQAYRHN | BCMA | 13.934 |
| 177 | MGSWYEFWVRLTAIRWRLEALGGSEAELAAFEKEIAAFESELQAYKGKGNPEVEWLREQAASIRWVLQAYRHN | BCMA | 5.72 |
| 178 | MGSWFEFDRRLKAIDRRLMALGGSEAELAAFEKEIAAFESELQAYKGKGNPEVEWLRMQAAIIRNYLQAYRHN | BCMA | 6.1625 |
| 179 | MGSWVEFWERLDAIDNRLGALGGSEAELAAFEKEIAAFESELQAYKGKGNPEVEWLRWHAAYIRGYLQAYRHN | BCMA | 11.42 |
| 180 | MGSWAEFWDRLDAIDSRLNALGGSEAELAAFEKEIAAFESELQAYKGKGNPEVEYLREWAAYIRGYLQAYRHN | BCMA | 18.22 |
| 181 | MGSWAEFDLRLRAIAKRLVALGGSEAELAAFEKEIAAFESELQAYKGKGNPEVEMLRLDAAYIRGVLQAYRHN | BCMA | 4.09 |
| 182 | MGSWSEFWDRLYAIRIRLDALGGSEAELAAFEKEIAAFESELQAYKGKGNPEVEKLRSVAARIRNWLQAYRHN | BCMA | 12.52 |
| 183 | MGSWSEFWFRLGAIRNRLDALGGSEAELAAFEKEIAAFESELQAYKGKGNPEVEKLRDVAAHIRHWLQAYRHN | BCMA | 14.93 |
| 184 | MGSWSEFNDRLDAIRWRLDALGGSEAELAAFEKEIAAFESELQAYKGKGNPEVEWLRQVAATIRYRLQAYRHN | BCMA | 13.59 |
| 185 | MGSWVEFWDRLGAIRERLQALGGSEAELAAFEKEIAAFESELQAYKGKGNPEVEKLRYTAAAIRHYLQAYRHN | BCMA | 5.22 |
| 186 | MGSWAEFWDRLGAIRERLQALGGSEAELAAFEKEIAAFESELQAYKGKGNPEVEKLRYTAAAIRHYLQAYRHN | BCMA | |
| 187 | MGSWTEFWDRLGAIRERLQALGGSEAELAAFEKEIAAFESELQAYKGKGNPEVEKLRYTAAAIRHYLQAYRHN | BCMA | |
| 188 | MGSWVEFWDRLGAIRERLQALGGSEAELAAFEKEIAAFESELQAYKGKGNPEVEKLKYTAAAIRHYLQAYRHN | BCMA | |
| 189 | MGSWVEFWDRLGAIRERLQALGGSEAELAAFEKEIAAFESELQAYKGKGNPEVEKLQYTAAAIRHYLQAYRHN | BCMA | |
| 190 | MGSWVEFWDRLGAIRERLQALGGSEAELAAFEKEIAAFESELQAYKGKGNPEVEKLRYTAAAIKHYLQAYRHN | BCMA | |
| 191 | MGSWAEFWDRLGAIRERLQALGGSEAELAAFEKEIAAFESELQAYKGKGNPEVEKLQYTAAAIKHYLQAYRHN | BCMA | |

TABLE 3-continued

Exemplary D-domains

| SEQ ID NO: | D-Domain Sequence | Target | ELISA_avg |
|---|---|---|---|
| 192 | MGSWTEFWDRLGAIRERLQALGGSEAELAAFEKEIAAFESELQAYKGKGNPEVEKLQYTAAAIKHYLQAYRHN | BCMA | |
| 193 | MGSWVEFWDRLGAIRERLEALGGSEAELAAFEKEIAAFESELQAYKGKGNPEVEKLRYVAAVIRHRLQAYRHN | BCMA | 4.18 |
| 194 | MGSWVEFWDRLGAIRERLQALGGSEAELAAFEKEIAAFESELQAYKGKGNPEVEELRASAAAIRIALQAYRHN | BCMA | 3.07 |
| 195 | MGSWVEFWDRLGAIRDRLDALGGSEAELAAFEKEIAAFESELQAYKGKGNPEVEELRNTAAYIRTFLQAYRHN | BCMA | 16.034 |
| 196 | MGSWSEFWVRLGAIRDRLDALGGSEAELAAFEKEIAAFESELQAYKGKGNPEVEALRVTAAQIRHYLQAYRHN | BCMA | 23.5 |
| 197 | MGSWSEFWVRLGAIRERLDALGGSEAELAAFEKEIAAFESELQAYKGKGNPEVEKLRYTAATIRRFLQAYRHN | BCMA | 7.5567 |
| 198 | MGSWSEFWARLGAIRERLDALGGSEAELAAFEKEIAAFESELQAYKGKGNPEVEKLRYTAATIRRFLQAYRHN | BCMA | |
| 199 | MGSWSEFWVRLGAIRERLDALGGSEAELAAFEKEIAAFESELQAYKGKGNPEVEKLRYTAGTIRRFLQAYRHN | BCMA | |
| 200 | MGSWSEFWVRLGAIRERLDALGGSEAELAAFEKEIAAFESELQAYKGKGNPEVEKLRYTAATIKRFLQAYRHN | BCMA | |
| 201 | MGSWSEFWARLGAIRERLDALGGSEAELAAFEKEIAAFESELQAYKGKGNPEVEKLRYTAGTIKRFLQAYRHN | BCMA | |
| 202 | MGSWSEFWDRLTAIRVRLDALGGSEAELAAFEKEIAAFESELQAYKGKGNPEVEKLRYTAAHIRKFLQAYRHN | BCMA | 16.14 |
| 203 | MGSWTEFWTRLNAIYERLDALGGSEAELAAFEKEIAAFESELQAYKGKGNPEVEKLRFTAASIRMYLQAYRHN | BCMA | 8.43 |
| 204 | MGSWFEFWDRLAAIRDRLEALGGSEAELAAFEKEIAAFESELQAYKGKGNPEVEDLRYVAAKIRVRLQAYRHN | BCMA | 12.78 |
| 205 | MGSWTEFWVRLNAIRDRLEALGGSEAELAAFEKEIAAFESELQAYKGKGNPEVEDLRHTAAIIRNYLQAYRHN | BCMA | 12.53 |
| 206 | MGSWVEFWHRLGAIYDRLEALGGSEAELAAFEKEIAAFESELQAYKGKGNPEVEELRRTAALIRQTLQAYRHN | BCMA | 19.904 |
| 207 | MGSWVEFWNRLGAIYDRLEALGGSEAELAAFEKEIAAFESELQAYKGKGNPEVEKLRHTAAVIRLYLQAYRHN | BCMA | 14.55 |
| 208 | MGSWSEFWERLEAIYDRLYALGGSEAELAAFEKEIAAFESELQAYKGKGNPEVEELRRTAATIRSFLQAYRHN | BCMA | 18.78 |
| 209 | MGSWEEFDNRLEAIFDRLEALGGSEAELAAFEKEIAAFESELQAYKGKGNPEVEELREFAATIRITLQAYRHN | BCMA | 3.93 |
| 210 | MGSWMEFWDRLYAIEFRLFALGGSEAELAAFEKEIAAFESELQAYKGKGNPEVEKLRRVAATIRNELQAYRHN | BCMA | 11.693 |
| 211 | MGSWTEFWERLYAIEYRLFALGGSEAELAAFEKEIAAFESELQAYKGKGNPEVEKLRSVAATIRYELQAYRHN | BCMA | 12.7 |
| 212 | MGSWNEFWERLYAIELRLFALGGSEAELAAFEKEIAAFESELQAYKGKGNPEVEKLRMTAAYIRNELQAYRHN | BCMA | 9.945 |
| 213 | MGSWYEFWKRLYAIEYRLFALGGSEAELAAFEKEIAAFESELQAYKGKGNPEVEALRKVAAKIREQLQAYRHN | BCMA | 14.785 |
| 214 | MGSWTEFWARLYAIEMRLFALGGSEAELAAFEKEIAAFESELQAYKGKGNPEVEHLRRVAALIREQLQAYRHN | BCMA | 12.46 |
| 215 | MGSWHEFWDRLYAIEFRLFALGGSEAELAAFEKEIAAFESELQAYKGKGNPEVESLRQVAAKIRWHLQAYRHN | BCMA | 7.3 |
| 216 | MGSWDEFEFRLGALRWRLIALGGSEAELAAFEKEIAAFESELQAYKGKGNPEVEYLRFGAAHIRHILQAYRHN | BCMA | 9.2 |

TABLE 3-continued

Exemplary D-domains

| SEQ ID NO: | D-Domain Sequence | Target | ELISA_avg |
|---|---|---|---|
| 217 | MGSWTEFYHRLYAIRERLSALGGSEAELAAFEKEIAAFESELQAYKGKGNP EVEYLRFGAAHIRHLLQAYRHN | BCMA | 9.6275 |
| 218 | MGSWVEFETRLDAIRMRLGALGGSEAELAAFEKEIAAFESELQAYKGKGNP EVEYLRFGAAHIRALLQAYRHN | BCMA | 14.072 |
| 219 | MGSWGEFDVRLFAIRERLSALGGSEAELAAFEKEIAAFESELQAYKGKGNP EVEYLRGYAAQIRSFLQAYRHN | BCMA | 7.3533 |
| 220 | MGSWVEFDERLSAIRERLDALGGSEAELAAFEKEIAAFESELQAYKGKGNP EVEYLRLYAAQIRVFLQAYRHN | BCMA | 5.61 |
| 221 | MGSWSEFDGRLGAIWDRLYALGGSEAELAAFEKEIAAFESELQAYKGKGNP EVEYLRDRAAQIREFLQAYRHN | BCMA | 10.031 |
| 222 | MGSWGEFEGRLHAIRSRLSALGGSEAELAAFEKEIAAFESELQAYKGKGNP EVEVLRGYAAWIRALLQAYRHN | BCMA | 6.17 |
| 223 | MGSWGEFNGRLGAIRERLQALGGSEAELAAFEKEIAAFESELQAYKGKGNP EVEFLRAYAASIRAVLQAYRHN | BCMA | 4.9533 |
| 224 | MGSWWEFTFRLAAIEFRLEALGGSEAELAAFEKEIAAFESELQAYKGKGNP EVEDLRAIAAEIRKSLQAYRHN | BCMA | 5.75 |
| 225 | MGSWDEFQFRLAAIGFRLGALGGSEAELAAFEKEIAAFESELQAYKGKGNP EVEVLRRQAARIRHLLQAYRHN | BCMA | 6.155 |
| 226 | MGSWYEFVTRLHAIDHRLKALGGSEADLAAFEKEIAAFESELQAYKGKGNP EVEWLRFYAAGIRMNLQAYRHN | BCMA | 4.12 |
| 227 | MGSWSIEFWRLEAIKFRLIALGGSEAELAAFEKEIAAFESELQAYKGKGNP EVEFLRVEAAAIRRVLQAYRHN | BCMA | 8.43 |
| 228 | MGSWGEFEHRLDPSTCVWLALGGSEAELAAFEKEIAAFESELQAYKGKGNP EVEKLRRGAAVIRHWLQAYRHN | BCMA | 4.05 |
| 229 | MGSWIEFAMRLEAIENRLTALGGSEAELAIFESMIAHFEELLQNYKGKGNP EVEALIHEAFAIHKELWAYRHN | BCMA | 10.73 |
| 230 | MGSWNEFYQRLEAIENRLQALGGSEAELAMFEVRIALFEDMLQGYKGKGNP EVEALKQEAIAILRELIAYRHN | BCMA | 6.01 |
| 231 | MGSWNEFYDRLRAIKKRLYALGGSEAELADFEEDIAQFEVDLQDYKGKGNP EVEALHREAHAITHELWAYRHN | BCMA | 12.36 |
| 232 | MGSWGEFKHRLALIKWYLEALGGSEAELAHFEDWIAVFEVQLQNYKGKGNP EVEALRKEAAAIRDELQAYRHN | BCMA | 17.09 |
| 233 | MGSWYEFKHRLAIIKWYLEALGGSEAELAKFEAWIAEFEMILQRYKGKGNP EVEALRKEAAAIRDELQAYRHN | BCMA | 5.505 |
| 234 | MGSWYEFKHRLAIIKWYLEALGGSEAELAHFEQYIADFEGTLQKYKGKGNP EVEALRKEAAAIRDELQAYRHN | BCMA | 14.833 |
| 235 | MGSWYNFKHRLAIIKWYLEALGGSEAELARFENFIANFETQLQLYKGKGNP EVEALRKEAAAIRDELQAYRHN | BCMA | 6.7615 |
| 236 | MGSWFQFKHRLAIIKWQLEALGGSEAELAWFEQWIADFEHQLQHYKGKGNP EVEALRKEAAAIRDELQAYRHN | BCMA | 10.39 |
| 237 | MGSWYNFKHRLAIIKWFLEALGGSEAELAVFEVWIADFEHQLQEYKGKGNP EVEALRKEAAAIRDELQAYRHN | BCMA | 16.38 |
| 238 | MGSWDAFKHRLALIKWYLEALGGSEAELAHFEEYIAEFESNLQSYKGKGNP EVEALRKEAAAIRDELQAYRHN | BCMA | 12.98 |
| 239 | MGSWDGFKHRLALIKWYLEALGGSEAELANFENWIAEFEQRLQYYKGKGNP EVEALRKEAAAIRDELQAYRHN | BCMA | 23.62 |
| 240 | MGSWNGFKHRLAIIKWYLEALGGSEAELASFESYIAEFESGLQEYKGKGNP EVEALRKEAAAIRDELQAYRHN | BCMA | 16.53 |
| 241 | MGSWNSFKHRLALIKWYLEALGGSEAELATFEWYIASFESELQQYKGKGNP EVEALRKEAAAIRDELQAYRHN | BCMA | 10.34 |

TABLE 3-continued

Exemplary D-domains

| SEQ ID NO: | D-Domain Sequence | Target | ELISA_avg |
|---|---|---|---|
| 242 | MGSWSDFKYRLAVIKFYLEALGGSEAELASFESFIAHFEDDLQKYKGKGNPEVEALRKEAAAIRDELQAYRHN | BCMA | 13.04 |
| 243 | MGSWSGFKYRLAVIKFYLEALGGSEAELASFELFIAKFEIDLQNYKGKGNPEVEALRKEAAAIRDELQAYRHN | BCMA | 13.066 |
| 244 | MGSWYGFKYRLAVIKWYLEALGGSEAELASFEKYIAHFEHDLQAYKGKGNPEVEALRKEAAAIRDELQAYRHN | BCMA | 9.05 |
| 245 | MGSWYGFKYRLAVIKWYLEALGGSEAELASFEKYIAQFEHDLQAYKGKGNPEVEALRKEAAAIRDELQAYRHN | BCMA | 7.6333 |
| 246 | MGSWYGFKYRLALIKWYLEALGGSEAELASFETYIADFEDLLQAYKGKGNPEVEALRKEAAAIRDELQAYRHN | BCMA | 13.03 |
| 247 | MGSWSTFKYHLAVIKWYLEALGGSEAELASFEDYIAQFETDLQEYKGKGNPEVEALRKEAAAIRDELQAYRHN | BCMA | 11.65 |
| 248 | MGSWHEFKYRLALIKWYLEALGGSEAELATFEHHIAQFEWDLQKYKGKGNPEVEALRKEAAAIRDELQAYRHN | BCMA | 16.19 |
| 249 | MGSWNMFKYRLAHIKWYLEALGGSEAELATFEAYIADFEVDLQKYKGKGNPEVEALRKEAAAIRDELQAYRHN | BCMA | 16.33 |
| 250 | MGSWHGFKYRLAIIKWWLEALGGSEAELAFFEEWIASFERDLQIYKGKGNPEVEALRKEAAAIRDELQAYRHN | BCMA | 6.025 |
| 251 | MGSWHGFKYRLAVIKWYLEALGGSEAELAMFEGWIAQFEITLQQYKGKGNPEVEALRKEAAAIRDELQAYRHN | BCMA | 5.99 |
| 252 | MGSWQGFKYRLAVIKWMLEALGGSEAELAFFENWIAEFETKLQQYKGKGNPEVEALRKEAAAIRDELQAYRHN | BCMA | 7.75 |
| 253 | MGSWSGFKYRLAVIKWYLEALGGSEAELATFEEWIAEFETELQFYKGKGNPEVEALRKEAAAIRDELQAYRHN | BCMA | 13.975 |
| 254 | MGSWGYFKYRLAMIKWYLEALGGSEAELASFESWIAEFEGSLQAYKGKGNPEVEALRKEAAAIRDELQAYRHN | BCMA | 13.018 |
| 255 | MGSWHAFKYKLAMIKWYLEALGGSEAELAHFEEWIAEFEALLQEYKGKGNPEVEALRKEAAAIRDELQAYRHN | BCMA | 11.63 |
| 256 | MGSWQHFKYRLAIIKWYLEALGGSEAELAFFESFIAKFEHDLQKYKGKGNPEVEALRKEAAAIRDELQAYRHN | BCMA | 8.91 |
| 257 | MGSWNDFKYRLAIIKYYLEALGGSEAELAHFESYIASFEHDLQNYKGKGNPEVEALRKEAAAIRDELQAYRHN | BCMA | 15.123 |
| 258 | MGSWGAFKYRLAIIKFYLEALGGSEAELARFEEFIANFEHDLQNYKGKGNPEVEALRKEAAAIRDELQAYRHN | BCMA | 12.88 |
| 259 | MGSWYNFKYRLAIIKFYLEALGGSEAELAQFEIWIAEFEHDLQGYKGKGNPEVEALRKEAAAIRDELQAYRHN | BCMA | 19.91 |
| 260 | MGSWEQFKYRLAIIKYMLEALGGSEAELAWFESWIANFESDLQHYKGKGNPEVEALRKEAAAIRDELQAYRHN | BCMA | 11.01 |
| 261 | MGSWQQFKYRLAIIKYYLEALGGSEAELAGFETYIAKFEEVLQSYKGKGNPEVEALRKEAAAIRDELQAYRHN | BCMA | 15.12 |
| 262 | MGSWAGFKYRLAVIKYYLEALGGSEAELAHFEQWIAHFEGMLQDYKGKGNPEVEALRKEAAAIRDELQAYRHN | BCMA | 12.68 |
| 263 | MGSWTAFKYRLAIIKFYLEALGGSEAELAHFESYIAHFEDMLQHYKGKGNPEVEALRKEAAAIRDELQAYRHN | BCMA | 7.43 |
| 264 | MGSWAHFKYRLAIIKFWLEALGGSEAELANFEEYIAEFESTLQVYKGKGNPEVEALRKEAAAIRDELQAYRHN | BCMA | 13.12 |
| 265 | MGSWANFKYRLALIKWHLEALGGSEAELASFEIWIADFEESLQWYKGKGNPEVEALRKEAAAIRDELQAYRHN | BCMA | 14.288 |
| 266 | MGSWATFKYRLALIKWHLEALGGSEAELADFEEYIAGFEEGLQKYKGKGNPEVEALRKEAAAIRDELQAYRHN | BCMA | 15.07 |

TABLE 3-continued

Exemplary D-domains

| SEQ ID NO: | D-Domain Sequence | Target | ELISA_avg |
|---|---|---|---|
| 267 | MGSWTHFKYRLALIKWWLEALGGSEAELAGFEVHIADFEAQLQMYKGKGNPEVEALRKEAAAIRDELQAYRHN | BCMA | 7.3669 |
| 268 | MGSWNTFKYHLAVIKFMLEALGGSEAELAFFEQWIAEFEVTLQSYKGKGNPEVEALRKEAAAIRDELQAYRHN | BCMA | 10.601 |
| 269 | MGSWTQFKYHLAVIKWYLEALGGSEAELAGFEQWIAEFEKTLQEYKGKGNPEVEALRKEAAAIRDELQAYRHN | BCMA | 21.118 |
| 270 | MGSWNQFKYRLAVIKFYLEALGGSEAELAHFETWIAAFEEQLQFYKGKGNPEVEALRKEAAAIRDELQAYRHN | BCMA | 12.85 |
| 271 | MGSWNEFKYHLAVIKFYLEALGGSEAELAHFETWIAEFEYELQKYKGKGNPEVEALRKEAAAIRDELQAYRHN | BCMA | 13.68 |
| 272 | MGSWVQFKYHLAVIKFYLEALGGSEAELAHFETWIAEFEVALQGYKGKGNPEVEALRKEAAAIRDELQAYRHN | BCMA | 12.696 |
| 273 | MGSWVDFKYHLAVIKFWLEALGGSEAELANFETWIANFEQELQMYKGKGNPEVEALRKEAAAIRDELQAYRHN | BCMA | 13.22 |
| 274 | MGSWVDFKYHLAVIKWYLEALGGSEAELADFENWIAHFESILQQYKGKGNPEVEALRKEAAAIRDELQAYRHN | BCMA | 10.43 |
| 275 | MGSWVEFKYHLAVIKFTLEALGGSEAELADFEEEIARFEMILQQYKGKGNPEVEALRKEAAAIRDELQAYRHN | BCMA | 6.92 |
| 276 | MGSWSHFKYHLALIKWYLEALGGSEAELAKFEFWIAEFEHNLQMYKGKGNPEVEALRKEAAAIRDELQAYRHN | BCMA | 7.93 |
| 277 | MGSWYHFKYHLALIKWYLEALGGSEAELAHFEHWIAEFEWTLQQYKGKGNPEVEALRKEAAAIRDELQAYRHN | BCMA | 8.85 |
| 278 | MGSWQGFKYHLALIKFYLEALGGSEAELAHFEHWLAEFEHDLQTYKGKGNPEVEALRKEAAAIRDELQAYRHN | BCMA | 21.2 |
| 279 | MGSWLSFKHHLALIKWYLEALGGSEAELASFEAWIALFEHQLQQYKGKGNPEVEALRKEAAAIRDELQAYRHN | BCMA | 6.305 |
| 280 | MGSWSEFKYKLALIKWYLEALGGSEAELAHFEGWIANFETTLQKYKGKGNPEVEALRKEAAAIRDELQAYRHN | BCMA | 11.288 |
| 281 | MGSWIEFKYKLAIIKFYLEALGGSEAELAHFEHWIADFEFVLQQYKGKGNPEVEALRKEAAAIRDELQAYRHN | BCMA | 14.88 |
| 282 | MGSWQNFKYHLAMIKWYLEALGGSEAELANFEEFIAQFEINLQHYKGKGNPEVEALRKEAAAIRDELQAYRHN | BCMA | 9.55 |
| 283 | MGSWYNFKYHLAIIKWWLEALGGSEAELADFEHYIADFERNLQEYKGKGNPEVEALRKEAAAIRDELQAYRHN | BCMA | 8.6264 |
| 284 | MGSWYQFKYHLAIIKWYLEALGGSEAELAGFENYIATFEQELQQYKGKGNPEVEALRKEAAAIRDELQAYRHN | BCMA | 18.41 |
| 285 | MGSWSHFKYHLAIIKFYLEALGGSEAELAGFEIWIAKFEDELQMYKGKGNPEVEALRKEAAAIRDELQAYRHN | BCMA | 9.34 |
| 286 | MGSWVGFKAHLAIIKWYLEALGGSEAELAGFEIFIADFEALLQMYKGKGNPEVEALRKEAAAIRDELQAYRHN | BCMA | 9.71 |
| 287 | MGSWVNFKYKLAIIKYMLEALGGSEAELAFFEDWIAEFERTLQQYKGKGNPEVEALRKEAAAIRDELQAYRHN | BCMA | 7.3895 |
| 288 | MGSWSNFKYRLAVIKYMLEALGGSEAELAFFEDWIADFELHLQVYKGKGNPEVEALRKEAAAIRDELQAYRHN | BCMA | 9.34 |
| 289 | MGSWTNFKYKLAVIKFMLEALGGSEAELAFFEDWIAGFEIDLQNYKGKGNPEVEALRKEAAAIRDELQAYRHN | BCMA | 11.408 |
| 290 | MGSWTGFKYRLAIIKFMLEALGGSEAELAFFEQWIADFENELQYYKGKGNPEVEALRKEAAAIRDELQAYRHN | BCMA | 13.89 |
| 291 | MGSWHNFKYRLAIIKFMLEALGGSEAELAWFENWIADFEDSLQDYKGKGNPEVEALRKEAAAIRDELQAYRHN | BCMA | 13.59 |

TABLE 3-continued

Exemplary D-domains

| SEQ ID NO: | D-Domain Sequence | Target | ELISA_avg |
|---|---|---|---|
| 292 | MGSWFAFKHRLAVIKYMLEALGGSEAELAFFEHWIAQFEHDLQQYKGKGNPEVEALRKEAAAIRDELQAYRHN | BCMA | 11.985 |
| 293 | MGSWYEFKHRLAVIKYMLEALGGSEAELAFFENWIAQFEHELQTYKGKGNPEVEALRKEAAAIRDELQAYRHN | BCMA | 3.71 |
| 294 | MGSWYKFKHKLAVIKYMLEALGGSEAELAWFEEWIAEFEVTLQDYKGKGNPEVEALRKEAAAIRDELQAYRHN | BCMA | 4.54 |
| 295 | MGSWFYFKQKLAFIKWYLEALGGSEAELANFEIYIAEFEVMLQQYKGKGNPEVEALRKEAAAIRDELQAYRHN | BCMA | 7.23 |
| 296 | MGSWFSFKHHLAVIKWNLEALGGSEAELASFEEQIAEFESVLQAYKGKGNPEVEALRKEAAAIRDELQAYRHN | BCMA | 6.45 |
| 297 | MGSWGNFKYRLAIIKFHLEALGSSEAELATFEAWIANFESMLQNYKGKGNPEVEALRKEAAAIRDELQAYRHN | BCMA | 22.7 |
| 298 | MGSWSYFKYGLAIIKIRLEALGGSEAELADFERWIAAFEHDLQYYKGKGNPEVEALRKEAAAIRDELQAYRHN | BCMA | 13.33 |
| 299 | MGSWSYFKFGLAHIKLRLEALGGSEAELADFEQWIASFEEQLQTYKGKGNPEVEALRKEAAAIRDELQAYRHN | BCMA | 18.354 |
| 300 | MGSWSYFKWGLAHIKLRLEALGGSEAELADFEFWIAEFEGLLQDYKGKGNPEVEALRKEAAAIRDELQAYRHN | BCMA | 17.64 |
| 301 | MGSWIYFKYGLAHIKTRLEALGGSEAELADFEQWIAEFEKMLQDYKGKGNPEVEALRKEAAAIRDELQAYRHN | BCMA | 21.12 |
| 302 | MGSWGYFKYGLATIKHRLEALGGSEAELADFELWIAKFEEQLQVYKGKGNPEVEALRKEAAAIRDELQAYRHN | BCMA | 14.01 |
| 303 | MGSWEYFKYGLATIKMHLEALGGSEAELADFEHWIAHFEHQLQMYKGKGNPEVEALRKEAAAIRDELQAYRHN | BCMA | 18.403 |
| 304 | MGSWSYFKYGLATIKEKLEALGGSEAELADFETWIAMFEKQLQEYKGKGNPEVEALRKEAAAIRDELQAYRHN | BCMA | 18.15 |
| 305 | MGSWHYFKNGLAIIKEKLEALGGSEAELADFEIWIAMFEMELQEYKGKGNPEVEALRKEAAAIRDELQAYRHN | BCMA | 19.85 |
| 306 | MGSWQYFKYGLAIIKIKLEALGGSEAELADFEAWIATFEKQLQHYKGKGNPEVEALRKEAAAIRDELQAYRHN | BCMA | 10.28 |
| 307 | MGSWVYFKHGLAVIKMRLEALGGSEAELADFETWIAQFEMTLQEYKGKGNPEVEALRKEAAAIRDELQAYRHN | BCMA | 21.45 |
| 308 | MGSWVYFKYGLAVIKEKLEALGGSEAELADFETWIAEFEFGLQQYKGKGNPEVEALRKEAAAIRDELQAYRHN | BCMA | 17.58 |
| 309 | MGSWYYFKYGLAVIKGKLEALGGSEAELADFETWIAKFENHLQSYKGKGNPEVEALRKEAAAIRDELQAYRHN | BCMA | 3.84 |
| 310 | MGSWTYFKYGLALIKYRLEALGGSEAELADFEEWIAQFEVSLQHYKGKGNPEVEALRKEAAAIRDELQAYRHN | BCMA | 15.21 |
| 311 | MGSWDYFKYGLALIKIKLEALGGSEAELADFEVWIAQFEMALQVYKGKGNPEVEALRKEAAAIRDELQAYRHN | BCMA | 15.76 |
| 312 | MGSWTYFKFGLAHIKDSLEALGGSEAELADFEQWIAMFEQDLQVYKGKGNPEVEALRKEAAAIRDELQAYRHN | BCMA | 17.01 |
| 313 | MGSWGYFKHGLAHIKSSLEALGGSEAELADFEVWIAAFENELQEYKGKGNPEVEALRKEAAAIRDELQAYRHN | BCMA | 18.505 |
| 314 | MGSWGYFKTGLAIIKAQLEALGGSEAELADFELWIAQFEETLQFYKGKGNPEVEALRKEAAAIRDELQAYRHN | BCMA | 12.75 |
| 315 | MGSWAYFKYGLAVIKLHLEALGGSEAELADFERYIAEFEYELQAYKGKGNPEVEALRKEAAAIRDELQAYRHN | BCMA | 13.44 |
| 316 | MGSWLDFKEGLADIKRSLEALGGSEAELADFEGVIALFEWKLQTYKGKGNPEVEALRKEAAAIRDELQAYRHN | BCMA | 3.03 |

TABLE 3-continued

Exemplary D-domains

| SEQ ID NO: | D-Domain Sequence | Target | ELISA_avg |
|---|---|---|---|
| 317 | MGSWEVFKHELAVIKDYLEALGGSEAELAHFEWGIAWFEGFLQDYKGKGNPEVEALRKEAAAIRDELQAYRHN | BCMA | 9.33 |
| 318 | MGSWIVFKQSLAWIKEHLEALGGSEAELAEFEFYIANFEHTLQNYKGKGNPEVEALRKEAAAIRDELQAYRHN | BCMA | 10.57 |
| 319 | MGSWIYFKDSLAYIKKYLEALGGSEAELATFEYYIANFEHELQYYKGKGNPEVEALRKEAAAIRDELQAYRHN | BCMA | 3.2 |
| 320 | MGSWDHFKYNLAWIKKYLEALGGSEAELATFEWYIANFEKRLQDYKGKGNPEVEALRKEAAAIRDELQAYRHN | BCMA | 9.81 |
| 321 | MGSWFTFKQNLAWIKLHLEALGGSEAELARFEYYIADFENKLQLYKGKGNPEVEALRKEAAAIRDELQAYRHN | BCMA | 14.204 |
| 322 | MGSWREFKYGLAHIKRVLEALGGSEAELAVFEYYIAKFEQELQEYKGKGNPEVEALRKEAAAIRDELQAYRHN | BCMA | 14.7 |
| 323 | MGSWIQFKYGLAHIKRTLEALGGSEAELAVFEWYIADFEQQLQGYKGKGNPEVEALRKEAAAIRDELQAYRHN | BCMA | 8.3567 |
| 324 | MGSWVEFKHNLAWIKVTLEALGGSEAELAVFEYYIAQFEEQLQEYKGKGNPEVEALRKEAAAIRDELQAYRHN | BCMA | 15.83 |
| 325 | MGSWISFKDNLAMIKEFLEALGGSEAELAVFEWYIATFEVELQDYKGKGNPEVEALRKEAAAIRDELQAYRHN | BCMA | 7.16 |
| 326 | MGSWHIFKDNLATIKAFLEALGGSEAELAVFEWYIAKFEEELQGYKGKGNPEVEALRKEAAAIRDELQAYRHN | BCMA | 3.47 |
| 327 | MGSWTSFKHGLAGIKRVLEALGGSEAELATFEWYIAQFERHLQAYKGKGNPEVEALRKEAAAIRDELQAYRHN | BCMA | 9.765 |
| 328 | MGSWQSFKHALADIKINLEALGGSEAELAQFEYAIAVFEYRLQAYKGKGNPEVEALRKEAAAIRDELQAYRHN | BCMA | 13.719 |
| 329 | MGSWHTFKEALAQIKGELEALGGSEAELASFEYAIAVFEYRLQMYKGKGNPEVEALRKEAAAIRDELQAYRHN | BCMA | 6.76 |
| 330 | MGSWTDFKTSLADIKAELEALGGSEAELAKFEYYIAIFEYRLQEYKGKGNPEVEALRKEAAAIRDELQAYRHN | BCMA | 18.76 |
| 331 | MGSWTNFKEGLAEIKRDLEALGGSEAELARFEYVIAVFEFRLQNYKGKGNPEVEALRKEAAAIRDELQAYRHN | BCMA | 12.327 |
| 332 | MGSWHTFKDGLAEIKSELEALGGSEAELAMFEYVIAIFEYRLQNYKGKGNPEVEALRKEAAAIRDELQAYRHN | BCMA | 10.65 |
| 333 | MGSWQFFKEHLASIKFWLEALGGSEAELAFFEDAIADFEYHLQNYKGKGNPEVEALRKEAAAIRDELQAYRHN | BCMA | 10.58 |
| 334 | MGSWTYFKEHLASIKFWLEALGGSEAELAFFEDAIAEFEKDLQYYKGKGNPEVEALRKEAAAIRDELQAYRHN | BCMA | 6.5951 |
| 335 | MGSWIIFKGYLAHIKHHLEALGGSEAELADFEFYIAIFEMELQKYKGKGNPEVEALRKEAAAIRDELQAYRHN | BCMA | 5.18 |
| 336 | MGSWYLFQSHLAHIKHHLEALGGSEAELAWFEFTIAGFEQELQHYKGKGNPEVEALRKEAAAIRDELQAYRHN | BCMA | 7.69 |
| 337 | MGSWYSFKWTLARIKLELEALGGSEAELAYFENVIAHFEMELQSYKGKGNPEVEALRKEAAAIRDELQAYRHN | BCMA | 4.05 |
| 338 | MGSWTTLKWRLAHIKQHLEALGGSEAELALFEYDIAHFEELLQYYKGKGNPEVEALRKEAAAIRDELQAYRHN | BCMA | 17.82 |
| 339 | MGSWYGFKWYLATIKKHLEALGGSEAELALFETEIATFELWLQDYKGKGNPEVEALRKEAAAIRDELQAYRHN | BCMA | 10.65 |
| 340 | MGSWIEFNMRVLAIEDRLWALGGSEAELAAFEKEIAAFESELQAYKGKGNPEVESLRYEACLDPWSSAAYRHN | CD123 | 3.2 |
| 341 | MGSWIEFHERLWAIEDRLWALGGSEAELAAFEKEIAAFESELQAYKGKGNPEVESLREMAASIRHGLQAYRHN | CD123 | 3.4 |

TABLE 3-continued

Exemplary D-domains

| SEQ ID NO: | D-Domain Sequence | Target | ELISA_avg |
|---|---|---|---|
| 342 | MGSWFEFYERLWAIDDRLWALGGSEAELAAFEKEIAAFESELQAYKGKGNPEVEWLREEAASIRSSLQAYRHN | CD123 | 6 |
| 343 | MGSWFEFWDRLEAIDDRLFALGGSEAELAAFEKEIAAFESELQAYKGKGNPEVESLRYNAAEIRKELQAYRHN | CD123 | 4.9 |
| 344 | MGSWHEFWSRLDAIDDRLFALGGSEAELAAFEKEIAAFESELQAYKGKGNPEVEYLRGAAADIRAELQAYRHN | CD123 | 3.8 |
| 345 | MGSWYEFWIRLEAIDDRLFALGGSEAELAAFEKEIAAFESELQAYKGKGNPEVDILRDFAADIRTELQAYRHN | CD123 | 10.4 |
| 346 | MGSWHEFWDRLEAIDDRLYALGGSEAELAAFEKEIAAFESELQAYKGKGNPEVEFLREEAAYIRELLQAYRHN | CD123 | 10.6 |
| 347 | MGSWEEFWDRLFAIDDRLWALGGSEAELAAFEKEIAAFESELQAYKGKGNPEVETLRNEAAEIRMALQAYRHN | CD123 | 3.1 |
| 348 | MGSWWEFDDRLFAIDTRLMALGGSEAELAAFEKEIAAFESELQAYKGKGNPEVESLREWAATIRMELQAYRHN | CD123 | 3.5 |
| 349 | MGSWTEFHDRLEAIDDRLWALGGSEAELAAFEKEIAAFESELQAYKGKGNPEVEYLREEAAQIRWELQAYRHN | CD123 | 5.8 |
| 350 | MGSWAEFEDRLWAIEDRLWALGGSEAELAAFEKEIAAFESELQAYKGKGNPEVEYLREEAAAIRFELQAYRHN | CD123 | 6.2 |
| 351 | MGSWVEFWRLEAIDSRLWALGGSEAELAAFEKEIAAFESELQAYKGKGNPEVEWLREEAAAIREDLQAYRHN | CD123 | 3.2 |
| 352 | MGSWVEFWQRLEAIESRLWALGGSEAELAAFEKEIAAFESELQAYKGKGNPEVEFLREEAAEIRWELQAYRHN | CD123 | 7.7 |
| 353 | MGSWSEFWQRLEAIEDRLWALGGSEAELAAFEKEIAAFESELQAYKGKGNPEVEWLRENAAMIRDELQAYRHN | CD123 | 4.7 |
| 354 | MGSWSEFITRLEAIDDRLWALGGSEAELAAFEKEIAAFESELQAYKGKGNPEVEILREEAAEIRQHLQAYRHN | CD123 | 3.3 |
| 355 | MGSWYEFETRLEAIYDRLWALGGSEAELAAFEKEIAAFESELQAYKGKGNPEVELLRVEAAEIREDLQAYRHN | CD123 | 3.2 |
| 356 | MGSWTEFYYRLEAIEDRLWALGGSEAELAAFEKEIAAFESELQAYKGKGNPEVEFLRVEAANIRDMLQAYRHN | CD123 | 7.5 |
| 357 | MGSWYEFVIRLEAIEDRLWALGGSEAELAAFEKEIAAFESELQAYKGKGNPEVEVLRWYAADIRHELQAYRHN | CD123 | 6.4 |
| 358 | MGSWTEFSIRLEAIYDRLVALGGSEAELAAFEKEIAAFESELQAYKGKGNPEVEVLRTYAANIRHELQAYRHN | CD123 | 11.9 |
| 359 | MGSWTEFSIRLEAIYDRLVALGGSEAELAAFEKEIAAFESELQAYKGKGNPEVEVLRTYAAFIRHELQAYRHN | CD123 | 10.2 |
| 360 | MGSWTEFVWRLEAIWDRLDALGGSEAELAAFEKEIAAFESELQAYKGKGNPEVEVLREDAAVIRHFLQAYRHN | CD123 | 3.6 |
| 361 | MGSWVEFHERLEAIEDRLMALGGSEAELAAFEKEIAAFESELQAYKGKGNPEVEYLREDAAFIRQLLQAYRHN | CD123 | 3.7 |
| 362 | MGSWVEFHDRLEAIEDRLYALGGSEAELAAFEKEIAAFESELQAYKGKGNPEVEWLREDAAYIRSILQAYRHN | CD123 | 4.6 |
| 363 | MGSWIEFYDRLEAIYDRLDALGGSEAELAAFEKEIAAFESELQAYKGKGNPEVEWLREDAAFIRSWLQAYRHN | CD123 | 7.5 |
| 364 | MGSWVEFDQRLEAIYDRLYALGGSEAELAAFEKEIAAFESELQAYKGKGNPEVEWLREDAAQIRKWLQAYRHN | CD123 | 5.1 |
| 365 | MGSWVEFHDRLEAIEDRLLALGGSEAELAAFEKEIAAFESELQAYKGKGNPEVEDLREYAAGIRWFLQAYRHN | CD123 | 3.3 |
| 366 | MGSWEEFAQRLYAIEWRLYALGGSEAELAAFEKEIAAFESELQAYKGKGNPEVEVLRYVAAQIRYHLQAYRHN | CD123 | 16.9 |

TABLE 3-continued

Exemplary D-domains

| SEQ ID NO: | D-Domain Sequence | Target | ELISA_avg |
|---|---|---|---|
| 367 | MGSWDEFAWRLDVIFARLGALGGSEAELAAFEKEIAAFESELQAYKGKGNPEVEELRKNAAQIRDGLQAYRHN | CD123 | 4.6 |
| 368 | MGSWDEFYYRLEAIEMRLGALGGSEAELAAFEKEIAAFESELQAYKGKGNPEVEELRHYAAQIRHMLQAYRHN | CD123 | 7.2 |
| 369 | MGSWEEFYDRLEAIYNRLGALGGSEAELAAFEKEIAAFESELQAYKGKGNPEVEVLREYAADIREMLQAYRHN | CD123 | 18.6 |
| 370 | MGSWDEFGRRLYAIEWQLYALGGEEAELAAFEKEIAAFESELQAYKGKGNPEVEALRKEAAVIRENLQAYRHN | CD123 | |
| 371 | MGSWDEFGRRLYAIEWQLYALGGTEAELAAFEKEIAAFESELQAYKGKGNPEVEALRKEAAVIRENLQAYRHN | CD123 | |
| 372 | MGSWDEFGRRLYAIETQLYALGGEEAELAAFEKEIAAFESELQAYKGKGNPEVEKLREIAAVIRENLQAYRHN | CD123 | |
| 373 | MGSWDEFGRRLYAIEWQLYALGGEEAELAAFEKEIAAFESELQAYKGKGNPEVEKLREIAAVIRENLQAYRHN | CD123 | |
| 374 | MGSWDEFGRRLYAIKWQLYALGGEEAELAAFEKEIAAFESELQAYKGKGNPEVEKLREIAAVIRENLQAYRHN | CD123 | |
| 375 | MGSWDEFGRRLYAIEWQLYALGGEEAELAAFEKEIAAFESELQAYKGKGNPEVEKLRKIAAVIRENLQAYRHN | CD123 | |
| 376 | MGSWDEFGRRLYAIEWQLYALGGGEAELAAFEKEIAAFESELQAYKGKGNPEVEKLREIAAVIRENLQAYRHN | CD123 | |
| 377 | MGSWDEFGRRLYAIEWQLYALGGTEAELAAFEKEIAAFESELQAYKGKGNPEVEKLREIAAVIRENLQAYRHN | CD123 | |
| 378 | MGSWDEFGRRLYAIEWQLYALGGEEAELAAFEKEIAAFESELQAYKGKGNPEVEKLREIAAVIRSNLQAYRHN | CD123 | |
| 379 | MGSWDEFGRRLYAIEWQLYALGGTEAELAAFEKEIAAFESELQAYKGKGNPEVEKLREIAAVIRSNLQAYRHN | CD123 | |
| 380 | MGSWDEFGRRLYAIEWQLYALGGEEAELAAFEKEIAAFESELQAYKGKGNPEVEKLREIAAVIRSNLQAYRHN | CD123 | |
| 381 | MGSWDEFGRRLAAIEWQLYALGGEEAELAAFEKEIAAFESELQAYKGKGNPEVEKLREIAAVIRENLQAYRHN | CD123 | |
| 382 | MGSWDEFGRRLYAIEWQLYALGGEEAELAAFEKEIAAFESELQAYKGKGNPEVEALREIAAVIRENLQAYRHN | CD123 | |
| 383 | MGSWDEFGRRLYAIEWQLYALGGEEAELAAFEKEIAAFESELQAYKGKGNPEVEKLREEAAVIRENLQAYRHN | CD123 | |
| 384 | MGSWDEFGRRLYAIEWRLYALGGSEAELAAFEKEIAAFESELQAYKGKGSPEVEKLREIAAVIRSNLQAYRHN | CD123 | |
| 385 | MGSWDEFGRRLYAIEWRLYALGGSEAELAAFEKEIAAFESELQAYKGKGNPEVEKLREIAAVIRSNLQAYRHN | CD123 | 5.8 |
| 386 | MGSWDEFGRRLYAIEWRLYALGGEEAELAAFEKEIAAFESELQAYKGKGNPEVEKLREIAAVIRSNLQAYRHN | CD123 | |
| 387 | MGSWDEFGRRLYAIEWQLYALGGSEAELAAFEKEIAAFESELQAYKGKGNPEVEKLREIAAVIRSNLQAYRHN | CD123 | |
| 388 | MGSWDEFSRRLYAIEWRLYALGGSEAELAAFEKEIAAFESELQAYKGKGNPEVEKLREIAAVIRSNLQAYRHN | CD123 | |
| 389 | MGSWDEFGRRLYAIEWRLYALGGSEAELAAFEKEIAAFESELQAYKGKGNPEVEKLREIAAVIRENLQAYRHN | CD123 | |
| 390 | MGSWDEFGRRLAAIKTQLAALGGEEAELAAFEKEIAAFESELQAYKGKGNPEVEKLREIAAVIRENLQAYRHN | CD123 | |
| 391 | MGSWDEFGRRLAAIKTQLAALGGTEAELAAFEKEIAAFESELQAYKGKGNPEVEKLREIAAVIRENLQAYRHN | CD123 | |

TABLE 3-continued

Exemplary D-domains

| SEQ ID NO: | D-Domain Sequence | Target | ELISA_avg |
|---|---|---|---|
| 392 | MGSWDEFGRRLAAIKTQLAALGGEEAELAAFEKEIAAFESELQAYKGKGNPEVEALRKEAAVIRENLQAYRHN | CD123 | |
| 393 | MGSWDEFGRRLAAIKTQLAALGGTEAELAAFEKEIAAFESELQAYKGKGNPEVEALRKEAAVIRENLQAYRHN | CD123 | |
| 394 | MGSWDEFEQRLIAIEERLFALGGSEAELAAFEKEIAAFESELQAYKGKGNPEVEWLREEAAVIRKYLQAYRHN | CD123 | 5.9 |
| 395 | MGSWVEFDQRLGAIWDRLVALGGSEAELAAFEKEIAAFESELQAYKGKGNPEVEHLRQGAAVIRDDLQAYRHN | CD123 | 5.3 |
| 396 | MGSWVEFDMRLSAIWERLIALGGSEAELAAFEKEIAAFESELQAYKGKGNPEVEWLREDAAEIREFLQAYRHN | CD123 | 3.3 |
| 397 | MGSWVEFDQRLDAIYERLYALGGSEAELAAFEKEIAAFESELQAYKGKGNPEVEWLRDEAAEIREHLQAYRHN | CD123 | 10.5 |
| 398 | MGSWHEFDQRLWAIEERLWALGGSEAELAAFEKEIAAFESELQAYKGKGNPEVETLRLYAALIRHDLQAYRHN | CD123 | 3.3 |
| 399 | MGSWVEFWDRLDAIEGRLWALGGSEAELAAFEKEIAAFESELQAYKGKGNPEVEDLRWLAAEIRADLQAYRHN | CD123 | 3.5 |
| 400 | MGSWVEFYSRLDAIEDRLWALGGSEAELAAFEKEIAAFESELQAYKGKGNPEVEWLRIAAASIREDLQAYRHN | CD123 | 9.4 |
| 401 | MGSWYEFYERLDAIEERLWALGGSEAELAAFEKEIAAFESELQAYKGKGNPEVEVLRDWAAWIREDLQAYRHN | CD123 | 8.4 |
| 402 | MGSWFEFDDRLWAIENRLWALGGSEAELAAFEKEIAAFESELQAYKGKGNPEVEVLRDNAAWIREILQAYRHN | CD123 | 4.2 |
| 403 | MGSWYEFWDRLDALEDRLWALGGSEAELAAFEKEIAAFESELQAYKGKGNPEVEYLRDSAAFIREELQAYRHN | CD123 | 9.7 |
| 404 | MGSWMEFVDRLDAIESRLWALGGSEAELAAFEKEIAAFESELQAYKGKGNPEVEWLRIEAAFIREELQAYRHN | CD123 | 5.8 |
| 405 | MGSWDEFVDRLWAIEERLWALGGSEAELAAFEKEIAAFESELQAYKGKGNPEVEELRIQAAIIREALQAYRHN | CD123 | 6 |
| 406 | MGSWFEFNYRLGAIEDRLWALGGSEAELAAFEKEIAAFESELQAYKGKGNPEVEMLRQIAAEIREFLQAYRHN | CD123 | 6.9 |
| 407 | MGSWEEFFTRLDAINERLEALGGSEAELAAFEKEIAAFESELQAYKGKGNPEVEMLRYEAAEIRHMLQAYRHN | CD123 | 3.9 |
| 408 | MGSWYEFSNRLDAIGERLWALGGSEAELAAFEKEIAAFESELQAYKGKGNPEVEILRHQAAEIRWFLQAYRHN | CD123 | 3.9 |
| 409 | MGSWYEFWGRLDAIEERLWALGGSEAELAAFEKEIAAFESELQAYKGRGNPEVEMLREDAAEIRGQLQAYRHN | CD123 | 5.4 |
| 410 | MGSWVEFWDRLWAIDYRLFALGGSEAELAAFEKEIAAFESELQAYKGKGNPEVEALRDEAAWIREELQAYRHN | CD123 | 3.6 |
| 411 | MGSWVEFVDRLWAIDERLDALGGSEAELAAFEKEIAAFESELQAYKGKGNPEVEFLRTWAAWIREDLQAYRHN | CD123 | 3.2 |
| 412 | MGSWFEFWDRLEAIWERLDALGGSEAELAAFEKEIAAFESELQAYKGKGNPEVEELRREAAIIREDLQAYRHN | CD123 | 10.3 |
| 413 | MGSWFEFEDRLEAIYQRLDALGGSEAELAAFEKEIAAFESELQAYKGKGNPEVEWLRDEAAWIRSDLQAYRHN | CD123 | 5.5 |
| 414 | MGSWFEFHDRLWAIDERLWALGGSEAELAAFEKEIAAFESELQAYKGKGNPEVEILREEAADIRLDLQAYRHN | CD123 | 3.5 |
| 415 | MGSWYEFEDRLWAIDNRLWALGGSEAELAAFEKEIAAFESELQAYKGKGNPEVEELRVHAADIRDDLQAYRHN | CD123 | 4.9 |
| 416 | MGSWFEFQDRLWAIDNRLWALGGSEAELAAFEKEIAAFESELQAYKGKGNPEVEELRDHAAMIRWELQAYRHN | CD123 | 3.2 |

TABLE 3-continued

Exemplary D-domains

| SEQ ID NO: | D-Domain Sequence | Target | ELISA_avg |
|---|---|---|---|
| 417 | MGSWDEFEERLFAIDERLWALGGSEAELAAFEKEIAAFESELQAYKGKGNPEVEALRYLAADIREELQAYRHN | CD123 | 5 |
| 418 | MGSWEEFWERLDAIDTRLWALGGSEAELAAFEKEIAAFESELQAYKGKGNPEVEVLRNDAADIREPLQAYRHN | CD123 | 6.8 |
| 419 | MGSWMEFWERLEAIDMRLWALGGSEAELAAFEKEIAAFESELQAYKGKGNPEVEYLRDDAAVIRDDLQAYRHN | CD123 | 4.2 |
| 420 | MGSWLEFMWRLDAIDERLWALGGSEAELAAFEKEIAAFESELQAYKGKGNPEVELLREMAAAIRDDLQAYRHN | CD123 | 5.1 |
| 421 | MGSWTEFYNRLDAIDQRLWALGGSEAELAAFEKEIAAFESELQAYKGKGNPEVEMLREYAADIRTDLQAYRHN | CD123 | 3.3 |
| 422 | MGSWWEFIWRLEAIEQRLWALGGSEAELAAFEKEIAAFESELQAYKGKGNPEVEVLRSRAADIRTDLQAYRHN | CD123 | 4 |
| 423 | MGSWSEFYDRLWAIEERLFALGGSEAELAAFEKEIAAFESELQAYKGKGNPEVEYLRYYAAEIREELQAYRHN | CD123 | 17 |
| 424 | MGSWSEFEDRLWAIDQRLFALGGSEAELAAFEKEIAAFESELQAYKGKGNPEVEWLRAYAADIRWELQAYRHN | CD123 | 4.2 |
| 425 | MGSWTEFWERLNAIDERLFALGGSEAELAAFEKEIAAFESELQAYKGKGNPEVEWLRLYAAEIRSELQAYRHN | CD123 | 4 |
| 426 | MGSWWEFEERLWAIDYRLHALGGSEAELAAFEKEIAAFESELQAYKGKGNPEVEMLRSWAAEIRALLQAYRHN | CD123 | 4.1 |
| 427 | MGSWWEFENRLWAIEERLEALGGSEAELAAFEKEIAAFESELQAYKGKGNPEVEMLRNYAAEIRWELQAYRHN | CD123 | 5.6 |
| 428 | MGSWVEFEERLWAIDERLGALGGSEAELAAFEKEIAAFESELQAYKGKGNPEVEWLRDWAADIRWWLQAYRHN | CD123 | 4.1 |
| 429 | MGSWVEFEERLEAIEERLFALGGSEAELAAFEKEIAAFESELQAYKGKGNPEVEWLRDDAANIRHWLQAYRHN | CD123 | 3.8 |
| 430 | MGSWMEFEERLWAIDSRLWALGGSEAELAAFEKEIAAFESELQAYKGKGNPEVEWLRSEAAWIRMELQAYRHN | CD123 | 3.2 |
| 431 | MGSWSEFEHRLEAIESRLFALGGSEAELAAFEKEIAAFESELQAYKGKGNPEVEDLRSEAAWIREQLQAYRHN | CD123 | 7.6 |
| 432 | MGSWFEFWERLDAIEWRLWALGGSEAELAAFEKEIAAFESELQAYKGKGNPEVEELRSTAADIRRYLQAYRHN | CD123 | 3.4 |
| 433 | MGSWFEFWGRLEAIESRLKALGGSEAELAAFEKEIAAFESELQAYKGKGNPEVEELREHAAWIRAYLQAYRHN | CD123 | 4.9 |
| 434 | MGSWQEFTMRLDAIYNRLETLGGSEAELAAFEKEIAAFESELQAYKGKGNPEVEWLRQSAANIRSELQAYRHN | CD123 | 13.7 |
| 435 | MGSWSEFNMRLDAIYERLTALGGSEAELAAFEKEIAAFESELQAYKGKGNPEVEWLRHSAARIRLELQAYRHN | CD123 | 13.7 |
| 436 | MGSWSEFNMRLDAIYERLTALGGSEAELAAFEKEIAAFESELQAYKGKGNPEVEWLRHSAALIRLELQAYRHN | CD123 | 11.4 |
| 437 | MGSWIEFNMRLDAIYERLVALGGSEAELAAFEKEIAAFESELQAYKGKGNPEVEWLRKVAANIRLELQAYRHN | CD123 | 11.4 |
| 438 | MGSWYEFHHRLDAIYERLLALGGSEAELAAFEKEIAAFESELQAYKGKGNPEVEWLRSSAANIRKELQAYRHN | CD123 | 11.9 |
| 439 | MGSWYEFAKRLDAIYERLVALGGSEAELAAFEKEIAAFESELQAYKGKGNPEVEWLRSSAANIREELQAYRHN | CD123 | 15.3 |
| 440 | MGSWTEFYVRLDAIYERLDALGGSEAELAAFEKEIAAFESELQAYKGKGNPEVEWLRMVAANIRTELQAYRHN | CD123 | 16 |
| 441 | MGSWVEFYTRLDAIYGRLDALGGSEAELAAFEKEIAAFESELQAYKGKGNPEVEWLRQVAANIRMELQAYRHN | CD123 | 14.4 |

TABLE 3-continued

Exemplary D-domains

| SEQ ID NO: | D-Domain Sequence | Target | ELISA_avg |
|---|---|---|---|
| 442 | MGSWVEFHMRLDAIYERLDALGGSEAELAAFEKEIAAFESELQAYKGKGNPEVEWLRTAAANIRVELQAYRHN | CD123 | 9.1 |
| 443 | MGSWYEFAIRLDAIYERLHALGGSEAELAAFEKEIAAFESELQAYKGKGNPEVEYLRVWAANIRTELQAYRHN | CD123 | 25.5 |
| 444 | MGSWNEFVIRLDAIYERLLALGGSEAELAAFEKEIAAFESELQAYKGKGNPEVEYLRMAAANIRMELQAYRHN | CD123 | 16.6 |
| 445 | MGSWSEFYVRVDAIYARLSALGGSEAELAAFEKEIAAFESELQAYKGKGNPEVEKLRVWAANIRHELQAYRHN | CD123 | 14.7 |
| 446 | MGSWSEFHVRLDAIYARLDALGGSEAELAAFEKEIAAFESELQAYKGKGNPEVERLREWAANIRRELQAYRHN | CD123 | 14.4 |
| 447 | MGSWVEFHLRLDAIYGRLMALGGSEAELAAFEKEIAAFESELQAYKGKGNPEVENLRVWAANIRELQAYRHN | CD123 | 17.5 |
| 448 | MGSWVEFEMRLDAIVGRLYALGGSEAELAAFEKEIAAFESELQAYKGKGNPEVEKLRRWAANIRSELQAYRHN | CD123 | 25.3 |
| 449 | MGSWVEFNIRLDAIYERLYALGGSEAELAAFEKEIAAFESELQAYKGKGNPEVEKLRHWAASIRRELQAYRHN | CD123 | 13.4 |
| 450 | MGSWHEFGVRLDAIYDRLMALGGSEAELAAFEKEIAAFESELQAYKGKGNPEVEFLRQAAANIRSELQAYRHN | CD123 | 15.6 |
| 451 | MGSWTEFNLRLDAIYDRLMALGGSEAELAAFEKEIAAFESELQAYKGKGNPEVEWLRASAAAIRVELQAYRHN | CD123 | 14.4 |
| 452 | MGSWTEFNLRLDAIYGRLSALGGSEAELAAFEKEIAAFESELQAYKGKGNPEVEFLRAAAANIRVELQAYRHN | CD123 | 19.3 |
| 453 | MGSWVEFNWRLDAIYDRLVALGGSEAELAAFEKEIAAFESELQAYKGKGNPEVEWLRVSAAKIRGELQAYRHN | CD123 | 9.3 |
| 454 | MGSWNEFAWRLDAIYSRLAALGGSEAELAAFEKEIAAFESELQAYKGKGNPEVEWLRVAAANIRYELQAYRHN | CD123 | 17.7 |
| 455 | MGSWTEFAWRLDAIYDRLLALGGSEAELAAFEKEIAAFESELQAYKGKGNPEVEWLRHVAANIRRELQAYRHN | CD123 | 16.1 |
| 456 | MGSWVEFSIRLDAIYTRLVALGGSEAELAAFEKEIAAFESELQAYKGKGNPEVEMLRKGAANIRKELQAYRHN | CD123 | 15.1 |
| 457 | MGSWVEFYIRLDAIYVRLMALGGSEAELAAFEKEIAAFESELQAYKGKGNPEVEKLRSYAANIRQELQAYRHN | CD123 | 16.1 |
| 458 | MGSWYEFSMRLDAIYDRLMALGGSEAELAAFEKEIAAFESELQAYKGKGNPEVEQLRGYAANIRNELQAYRHN | CD123 | 13 |
| 459 | MGSWVEFIYRLDAIYDRLEALGGSEAELAAFEKEIAAFESELQAYKGKGNPEVEVLRRYAANIRNELQAYRHN | CD123 | 17 |
| 460 | MGSWIEFEVRLDAIYNRLAALGGSEAELAAFEKEIAAFESELQAYKGKGNPEVERLRRYAANIRHELQAYRHN | CD123 | 20.8 |
| 461 | MGSWFEFYDRLDAIYMRLIALGGSEAELAAFEKEIAAFESELQAYKGKGNPEVEVLRRYAANIKAELQAYRHN | CD123 | 13.6 |
| 462 | MGSWFEFYMRLDAIYDRLTALGGSEAELAAFEKEIAAFESELQAYKGKGNPEVERLRTFAANIRKELQAYRHN | CD123 | 13.1 |
| 463 | MGSWYEFDYRLDAIYDRLAALGGSEAELAAFEKEIAAFESELQAYKGKGNPEVERLRKWAANIREELQAYRHN | CD123 | 24.9 |
| 464 | MGSWSEFYLRLDAIYDRLDALGGSEAELAAFEKEIAAFESELQAYKGKGNPEVEWLRKTAANIREELQAYRHN | CD123 | 15.7 |
| 465 | MGSWFEFYERLDAINWRLFALGGSEAELAAFEKEIAAFESELQAYKGKGNPEVEALRGEAAAIREDLQAYRHN | CD123 | 3 |
| 466 | MGSWNEFEDRLDAIWWRLFALGGSEAELAAFEKEIAAFESELQAYKGKGNPEVEALRVEAAFIRTMLQAYRHN | CD123 | 5.1 |

TABLE 3-continued

Exemplary D-domains

| SEQ ID NO: | D-Domain Sequence | Target | ELISA_avg |
|---|---|---|---|
| 467 | MGSWFYFKDDLADINYMLEALGGSEAELAMFEDDIAGFELTLLKYKGKGNPEVEALRKEAAAIRDELQAYRHN | CD123 | 3.7 |
| 468 | MGSWHFFKDDLAWIKNELEALGGSEAELAMFEDDIAMFETMLQSYKGKGNPEVEALRKEAAAIRDELQAYRHN | CD123 | 3.2 |
| 469 | MGSWHWFKTDLADIKEELEALGGSEAELAMFEDDIAEFEEFLQMYKGKGNPEVEALRKEAAAIRDELQAYRHN | CD123 | 3.5 |
| 470 | MGSWWLFKDDLAEIKYWLEALGGSEAELAFFEDDIAEFERGLQIYKGKGNPEVEALRKEAAAIRDELQAYRHN | CD123 | 3.3 |
| 471 | MGSWYEFKDDLAEIKEWLEALGGSEAELAFFELDIADFEWLLQLYKGKGNPEVEALRKEAAAIRDELQAYRHN | CD123 | 3.8 |
| 472 | MGSWQWFKDDLAYIKETLEALGGSEAELALFEDMIADFEFELQWYKGKGNPEVEALRKEAAAIRDELQAYRHN | CD123 | 6.3 |
| 473 | MGSWILFKDDLAWIKETLEALGGSEAELAFFEDNIADFEEQLQGYKGKGNPEVEALRKEAAAIRDELQAYRHN | CD123 | 6 |
| 474 | MGSWIVFKDDLADIKRWLEALGGSEAELAMFEDEIADFEWQLQDYKGKGNPEVEALRKEAAAIRDELQAYRHN | CD123 | 3.9 |
| 475 | MGSWGHFKQDLAWIKDTLEALGGSEAELAFFEDDIAMFEMLQDYKGKGNPEVEALRKEAAAIRDELQAYRHN | CD123 | 4.9 |
| 476 | MGSWGYFKDDLAWIKGELEALGGSEAELAEFEWFIAVFEEDLQVYKGKGNPEVEALRKEAAAIRDELQAYRHN | CD123 | 4.5 |
| 477 | MGSWYWFKDDLAEIKGLLEALGGSEAELAEFEDEIAVFEQELQEYKGKGNPEVEALRKEAAAIRDELQAYRHN | CD123 | 10.4 |
| 478 | MGSWMFFKEDLADIKWALEALGGSEAELAFFEEEIALFEQHLQQYKGKGNPEVEALRKEAAAIRDELQAYRHN | CD123 | 3.2 |
| 479 | MGSWTFFKEDLAGIKWELEALGGSEAELAWFEDEIALFEEELQEYKGKGNPEVEALRKEAAAIRDELQAYRHN | CD123 | 7 |
| 480 | MGSWVFFKDDLADIKDELEALGGSEAELAFFEIAIALFEWELQEYKGKGNPEVEALRKEAAAIRDELQAYRHN | CD123 | 8.8 |
| 481 | MGSWTFFKNDLAEIKDWLEALGGSEAELADFEWDIAEFEYSLQEYKGKGNPEVEALRKEAAAIRDELQAYRHN | CD123 | 3.9 |
| 482 | MGSWTYFKDDLADIKQWLEALGGSEAELAFFEIEIAEFEEELQEYKGKGNPEVEALRKEAAAIRDELQAYRHN | CD123 | 4.6 |
| 483 | MGSWTVFKYDLADIKWWLEALGGSEAELADFEEEIAEFEEELQEYKGKGNPEVEALRKEAAAIRDELQAYRHN | CD123 | 3.9 |
| 484 | MGSWYWFKQDLAHIKSMLEALGGSEAELAWFEEDIADFESELQEYKGKGNPEVEALRKEAAAIRDELQAYRHN | CD123 | 3.3 |
| 485 | MGSWTFFKWDLADIKANLEALGGSEAELAWFEEDLAGFEAELQEYKGKGNPEVEALRKEAAAIRDELQAYRHN | CD123 | 4.8 |
| 486 | MGSWSFFKEELANIQVYLEALGGSEAELAWFEEDIADFEEDLQHYKGKGNPEVEALRKEAAAIRDELQAYRHN | CD123 | 3.8 |
| 487 | MGSWEFFKYELADIKDELEALGGSEAELAWFEEDIATFEEWLQGYKGKGNPEVEALRKEAAAIRDELQAYRHN | CD123 | 3.4 |
| 488 | MGSWQTFKDELAHIKWELEALGGSEAELAWFEWDIANFEEELQEYKGKGNPEVEALRKEAAAIRDELQAYRHN | CD123 | 5.5 |
| 489 | MGSWYWFKEELAFIKWELEALGGSEAELALFEEDIAYFEEMLQEYKGKGNPEVEALRKEAAAIRDELQAYRHN | CD123 | 9.4 |
| 490 | MGSWNSFKDELAEIKAELEALGGSEAELAFFEEDIAWFEEHLQQYKGKGNPEVEALRKEAAAIRDELQAYRHN | CD123 | 3.3 |
| 491 | MGSWDLFKWELAEIKLGLEALGGSEAELAEFEYDIAWFEEDLQDYKGKGNPEVEALRKEAAAIRDELQAYRHN | CD123 | 3.4 |

TABLE 3-continued

Exemplary D-domains

| SEQ ID NO: | D-Domain Sequence | Target | ELISA_avg |
|---|---|---|---|
| 492 | MGSWIFFKQDLAEIKLNLEALGGSEAELAWFEDDIAWFESHLQDYKGKGNPEVEALRKEAAAIRDELQAYRHN | CD123 | 3.8 |
| 493 | MGSWHLFKWTLAEIKYELEALGGSEAELAWFEDDIATFEEELQWYKGKGNPEVEALRKEAAAIRDELQAYRHN | CD123 | 4 |
| 494 | MGSWVTFKDELADIKDFLEALGGSEAELAFFEVDIAEFEAELQFYKGKGNPEVEALRKEAAAIRDELQAYRHN | CD123 | 7.6 |
| 495 | MGSWVYFKDELADIKDFLEALGGSEAELAEFEEDIATFEYDLQWYKGKGNPEVEALRKEAAAIRDELQAYRHN | CD123 | 4.6 |
| 496 | MGSWETFKYELAEIKDYLEALGGSEAELAWFEDDIAEFEFELQYYKGKGNPEVEALRKEAAAIRDELQAYRHN | CD123 | 4.4 |
| 497 | MGSWNTFKYELAEIKHFLEALGGSEAELAMFEDDIAMFEWELQEYKGKGNPEVEALRKEAAAIRDELQAYRHN | CD123 | 5 |
| 498 | MGSWYVFKDELAEIKQFLEALGGSEAELAWFEDDIAEFETQLQHYKGKGNPEVEALRKEAAAIRDELQAYRHN | CD123 | 9.9 |
| 499 | MGSWIFFKEQLAIIKWELEALGGSEAELAWFEDDIAAFEDDLQFYKGQGNPEVEALRKEAAAIRDELQAYRHN | CD123 | 15 |
| 500 | MGSWEFFKEVLAEIKYDLEALGGSEAELAWFETDIAGFEIDLQVYKGKGNPEVEALRKEAAAIRDELQAYRHN | CD123 | 8.2 |
| 501 | MGSWVFFKEDLATIKNDLEALGGSEAELAWFEMMIADFEADLQYYKGKGNPEVEALRKEAAAIRDELQAYRHN | CD123 | 3.1 |
| 502 | MGSWEEFKEDLAEIKVWLEALGGSEAELAWFEMGIADFEDGLQFYKGKGNPEVEALRKEAAAIRDELQAYRHN | CD123 | 4.3 |
| 503 | MGSWHWFKEDLANIKDWLEALGGSEAELAWFEDNIADFEGDLQVYKGKGNPEVEALRKEAAAIRDELQAYRHN | CD123 | 3.3 |
| 504 | MGSWFWFKEDLAFIKEDLEALGGSEAELAWFEDGIAFFEWDLQDYKGKGNPEVEALRKEAAAIRDELQAYRHN | CD123 | 13.7 |
| 505 | MGSWQWFKEDLAEIKHDLEALGGSEAELAWFEDFIAQFEFDLQWYKGKGNPEVEALRKEAAAIRDELQAYRHN | CD123 | 3.8 |
| 506 | MGSWHWFKEDLAIIKQDLEALGGSEAELATFEQWIAEFEWDLQEYKGKGNPEVEALRKEAAAIRDELQAYRHN | CD123 | 5.5 |
| 507 | MGSWNWFKEDLAIIKMDLEALGGSEAELAWFEHNIAGFEFELQGYKGKGNPEVEALRKEAAAIRDELQAYRHN | CD123 | 3.1 |
| 508 | MGSWSWFKEDLAEIKMELEALGGSEAELAYFEWYIAEFEFQLQHYKGKGNPEVEALRKEAAAIRDELQAYRHN | CD123 | 4.8 |
| 509 | MGSWSWFKQDLADIKIQLEALGGSEAELAWFEWDIAEFEFELQDYKGKGNPEVEALRKEAAAIRDELQAYRHN | CD123 | 4 |
| 510 | MGSWSWFKEDLADIKFELEALGGSEAELAWFELDIADFEQALQQYKGKGNPEVEALRKEAAAIRDELQAYRHN | CD123 | 6.8 |
| 511 | MGSWSWFKEDLASIKAVLEALGGSEAELAFFESDIAEFEQELQYYKGKGNPEVEALRKEAAAIRDELQAYRHN | CD123 | 6.9 |
| 512 | MGSWWEFKEDLAEIKWFLEALGGSEAELAWFEHDIAKFEFELQYYKGKGNPEVEALRKEAAAIRDELQAYRHN | CD123 | 5.1 |
| 513 | MGSWEWFKSDLASIKWELEALGGSEAELAWFEHDIAEFEEDLQWYKGKGNPEVEALRKEAAAIRDELQAYRHN | CD123 | 5.7 |
| 514 | MGSWNEFKDDLAMIKMTLEALGGSEAELAWFEHDIAEFEDDLQWYKGKGNPEVEALRKEAAAIRDELQAYRHN | CD123 | 3.5 |
| 515 | MGSWTFFKDDLAEIKWMLEALGGSEAELAWFESDIAYFEDELQWYKGKGNPEVEALRKEAAAIRDELQAYRHN | CD123 | 3.3 |
| 516 | MGSWSDFKDDLAEIKMILEALGGSEAELAYFENDIAWFEDDLQEYKGKGNPEVEALRKEAAAIRDELQAYRHN | CD123 | 4.7 |

TABLE 3-continued

Exemplary D-domains

| SEQ ID NO: | D-Domain Sequence | Target | ELISA_avg |
|---|---|---|---|
| 517 | MGSWSMFKDDLAEIKASLEALGGSEAELAWFEDDIAWFEDDLQHYKGKGNPEVEALRKEAAAIRDELQAYRHN | CD123 | 5.2 |
| 518 | MGSWQYFKDDLAEIKMVLEALGGSEAELAWFEADIAMFEDDLQIYKGKGNPEVEALRKEAAAIRDELQAYRHN | CD123 | 3.6 |
| 519 | MGSWSFFKDDLAEIKYFLEALGGSEAELAMFEQTIAEFEYDLQDYKGKGNPEVEALRKEAAAIRDELQAYRHN | CD123 | 10.1 |
| 520 | MGSWMEFKEELAEIKYILEALGGSEAELAWFEQSIADFEYDLQDYKGKGNPEVEALRKEAAAIRDELQAYRHN | CD123 | 5 |
| 521 | MGSWAWFKEDLAEIKVFLEALGGSEAELAEFEVSIADFEYELQDYKGKGNPEVEALRKEAAAIRDELQAYRHN | CD123 | 3.5 |
| 522 | MGSWYEFKFDLAEIKEQLEALGGSEAELALFEDDIAFFEYDLQNYKGKGNPEVEALRKEAAAIRDELQAYRHN | CD123 | 4.6 |
| 523 | MGSWYDFKYDLAEIKMDLEALGGSEAELAQFEFDIAFFEEELQDYKGKGNPEVEALRKEAAAIRDELQAYRHN | CD123 | 3.2 |
| 524 | MGSWYIFKEDLAEIKEELEALGGSEAELAYFEEEIALFEMELQWYKGKGNPEVEALRKEAAAIRDELQAYRHN | CD123 | 11.1 |
| 525 | MGSWVLFKEELAYIKFELEALGGSEAELALFENVIAIFESNLQNYKGKGNPEVEALRKEAAAIRDELQAYRHN | CD123 | 3.5 |
| 526 | MGSWQDFKEDLAWIKYELEALGGSEAELAFFEYDIAIFENNLQHYKGKGNPEVEALRKEAAAIRDELQAYRHN | CD123 | 3.2 |
| 527 | MGSWDHFKNDLAWIKKHLEALGGSEAELAEFEAVIAYFELYLQGYKGKGNPEVEALRKEAAAIRDELQAYRHN | CD123 | 3.3 |
| 528 | MGSWYDFKEDLADIKWMLEALGGSEAELAEFENVIAYFENDLQEYKGKGNPEVEALRKEAAAIRDELQAYRHN | CD123 | 8 |
| 529 | MGSWYMFKEELADIKWYLEALGGSEAELAWFEDDIAGFEWDLQAYKGKGNPEVEALRKEAAAIRDELQAYRHN | CD123 | 7 |
| 530 | MGSWYYFKDELADIKWDLEALGGSEAELAWFEMLIAQFELDLQWYKGKGNPEVEALRKEAAAIRDELQAYRHN | CD123 | 4 |
| 531 | MGSWMYFKDTLADIKWYLEALGGSEAELAFFEDWIAEFEDDLQVYKGKGNPEVEALRKEAAAIRDELQAYRHN | CD123 | 3.1 |
| 532 | MGSWYQFKHDLADIKYGLEALGGSEAELAWFEDDIADFELDLQYYKGKGNPEVEALRKEAAAIRDELQAYRHN | CD123 | 4.7 |
| 533 | MGSWYVFKDDLADIKYMLEALGGSEAELAWFEWEIANFEFDLQYYKGKGNPEVEALRKEAAAIRDELQAYRHN | CD123 | 3.8 |
| 534 | MGSWNFFKYDLADIMAYLEALGGSEAELAFFEDEIANFEHDLQKYKGKGNPEVEALRKEAAAIRDELQAYRHN | CD123 | 4.4 |
| 535 | MGSWHWFKIVLADIKDGLEALGGSEAELAYFETTIADFEMDLQHYKGKGNPEVEALRKEAAAIRDELQAYRHN | CD123 | 4.3 |
| 536 | MGSWHWFKIVLADIKDGLEALGGSEAELAYFETTIADFEMDLHHYKGKGNPEVEALRKEAAAIRDELQAYRHN | CD123 | 3.5 |
| 537 | MGSWFMFKEELADIKDWLEALGGSEAELASFESYIAWFEQDLQWYKGKGNPEVEALRKEAAAIRDELQAYRHN | CD123 | 5.7 |
| 538 | MGSWFMFKQELAWIKEDLEALGGSEAELADFEWDIAEFEWDLQYYKGKGNPEVEALRKEAAAIRDELQAYRHN | CD123 | 7.2 |
| 539 | MGSWQIFKGELAYIKQYLEALGGSEAELAFFEFDIAEFEEDLQYYKGKGNPEVEALRKEAAAIRDELQAYRHN | CD123 | 4.7 |
| 540 | MGSWDFFKEELAEIKHYLEALGGSEAELAFFEFWIADFEQDLQEYKGKGNPEVEALRKEAAAIRDELQAYRHN | CD123 | 3.7 |
| 541 | MGSWFNFKEELAVIKFQLEALGGSEAELAFFEWVIADFEDDLQEYKGKGNPEVEALRKEAAAIRDELQAYRHN | CD123 | 6.1 |

TABLE 3-continued

Exemplary D-domains

| SEQ ID NO: | D-Domain Sequence | Target | ELISA_avg |
|---|---|---|---|
| 542 | MGSWYQFKTELAWIKDDLEALGGSEAELAWFEWVIADFEDDLQFYKGKGNPEVEALRKEAAAIRDELQAYRHN | CD123 | 6.6 |
| 543 | MGSWFEFKDYLADIKWDLEALGGSEAELAIFEHDIAYFEHNLQQYKGKGNPEVEALRKEAAAIRDELQAYRHN | CD123 | 3.8 |
| 544 | MGSWVRFKDFLADIKMDLEALGGSEAELADFEYHIAEFEHNLQEYKGKGNPEVEALRKEAAAIRDELQAYRHN | CD123 | 5.8 |
| 545 | MGSWWLFKEQLALIKYNLEALGGSEAELADFESWIAEFEHQLQEYKGKGNPEVEALRKEAAAIRDELQAYRHN | CD123 | 4.1 |
| 546 | MGSWHVFKTELADIKFYLEALGGSEAELAMFELWIAEFEHELQDYKGKGNPEVEALRKEAAAIRDELQAYRHN | CD123 | 5.4 |
| 547 | MGSWIWFKDWLADIKDLLEALGGSEAELAEFEYDIALFEDQLQAYKGKGNPEVEALRKEAAAIRDELQAYRHN | CD123 | 7.3 |
| 548 | MGSWGWFKHELAFIKADLEALGGSEAELAWFEEEIAEFEYELQFYKGKGNPEVEALRKEAAAIRDELQAYRHN | CD123 | 3.3 |
| 549 | MGSWTWFKDNLAWIKEDLEALGGSEAELAWFELEIASFETALQDYKGKGNPEVEALRKEAAAIRDELQAYRHN | CD123 | 6.9 |
| 550 | MGSWTYFKNDLAGIKEDLEALGGSEAELAQFEFEIAEFEWLLQDYKGKGNPEVEALRKEAAAIRDELQAYRHN | CD123 | 3.6 |
| 551 | MGSWTWFKWDLADIKGDLEALGGSEAELAFFEEEIAEFEWRLQDYKGKGNPEVEALRKEAAAIRDELQAYRHN | CD123 | 5.9 |
| 552 | MGSWLYFKEYLADIKSDLEALGGSEAELAWFEYEIADFEEQLQYYKGKGNPEVEALRKEAAAIRDELQAYRHN | CD123 | 3.7 |
| 553 | MGSWHWFKEELAEIKEDLVALGGSEAELAWFEYDIAMFELSLQNYKGKGNPEVEALRKEAAAIRDELQAYRHN | CD123 | 3.1 |
| 554 | MGSWNDFKEELAWIKFDLEALGGSEAELAWFEEDIAMFEQQLQAYKGKGNPEVEALRKEAAAIRDELQAYRHN | CD123 | 3.8 |
| 555 | MGSWWDFKDWLAEIKHDLEALGGSEAELALFESEIADFEFGLQWYKGKGNPEVEALRKEAAAIRDELQAYRHN | CD123 | 4.2 |
| 556 | MGSWDEFKEDLAHIKTDLEALGGSEAELALFEDEIADFEMYLQHYKGKGNPEVEALRKEAAAIRDELQAYRHN | CD123 | 6.3 |
| 557 | MGSWDFFKYDLANINEWLEALGGSEAELADFEYGIADFELWLQDYKGKGNPEVEALRKEAAAIRDELQAYRHN | CD123 | 5.5 |
| 558 | MGSWYQFKDDLAHIKHLLEALGGSEAELAVFEYIIADFESFLQIYKGKGNPEVEALRKEAAAIRDELQAYRHN | CD123 | 4 |
| 559 | MGSWAEFKHDLADIKRELEALGGSEAELAWFELSIAFFEDELQHYKGKGNPEVEALRKEAAAIRDELQAYRHN | CD123 | 3.3 |
| 560 | MGSWVVFKQDLADINHQLEALGGSEAELAWFEWEIADFEWELQHYKGKGNPEVEALRKEAAAIRDELQAYRHN | CD123 | 3.6 |
| 561 | MGSWFQFKEFLAMITHNLEALGGSEAELAEFEHDIALFESELQQYKGKGNPEVEALRKEAAAIRDELQAYRHN | CD123 | 3.1 |
| 562 | MGSWHWFKEDLAMITDVLEALGGSEAELAAFESEIAVFEADLQYYKGKGNPEVEALRKEAAAIRDELQAYRHN | CD123 | 5.2 |
| 563 | MGSWSWFQWDLAGIKDHLEALGGSEAELAEFESEIAYFEDELQWYKGKGNPEVEALRKEAAAIRDELQAYRHN | CD123 | 12.9 |
| 564 | MGSWTEFKGELAEIKWILEALGGSEAELAFFEDEIAAFEWDLQKYKGKGNPEVEALRKEAAAIRDELQAYRHN | CD123 | 8.2 |
| 565 | MGSWFEFKWTLALIKQELEALGGSEAELADFEQEIAEFEWWLQTYKGKGNPEVEALRKEAAAIRDELQAYRHN | CD123 | 4.9 |
| 566 | MGSWAEFKQRLAAIKTRLEALGGSEAELAAFMDEIMAFEWELWAYKGKGNPEVEALMNEAFAIDVELYAYRHN | CD123 | 3.4 |

TABLE 3-continued

Exemplary D-domains

| SEQ ID NO: | D-Domain Sequence | Target | ELISA_avg |
|---|---|---|---|
| 567 | MGSWAEFKQRLAAIKTRLEALGGSEAELAAFEWEIVAFFSELFAYKGKGNPEVEALRDEAIAIETELVAYRHN | CD123 | 3.6 |
| 568 | MGSWWEFDHRLTAIDTRLQALGGSEAELAEFESSIAEFEWWLQDYKGKGNPEVEALFAEAEAIYVELDAYRHN | CD123 | 4.3 |
| 569 | MGSWWEFQFRLYAIDQRLLALGGSEAELAEFEQDIADFEWMLQDYKGKGNPEVEALMLEADAIEAELKAYRHN | CD123 | 3.1 |
| 570 | MGSWYEFDHRLDAIYQRLWALGGSEAELAEFEYGIAEFEEYLQDYKGKGNPEVEALISEAWAIEWELSAYRHN | CD123 | 4.6 |
| 571 | MGSWYEFDMRLDAIWERLTALGGSEAELADFEQYIAEFERQLQDYKGKGNPEVEALFDEAWAIEDELYAYRHN | CD123 | 13.7 |
| 572 | MGSWSEFDSRLDAIAYRLFALGGSEAELAQFEWIIADFEEDLQMYKGKGNPEVEALFSEAYAIEIELNAYRHN | CD123 | 4.3 |
| 573 | MGSWYEFDDRLDAIAYRLNALGGSEAELAWFEWEIAEFELDLQWYKGKGNPEVEALVWEADAIEWELEAYRHN | CD123 | 4.6 |
| 574 | MGSWFEFDERLDAIGSRLTALGGSEAELASFEFYIADFEEWLQQYKGKGNPEVEALEWEAFAIDEELGAYRHN | CD123 | 3.8 |
| 575 | MGSWEEFDQRLDAIDVRLYALGGSEAELAEFEFDIAAFEEWLQLYKGKGNPEVEALNMEAFAITDELCAYRHN | CD123 | 3.6 |
| 576 | MGSWEEFDVRLDAIFNRLWALGGSEAELAEFEFDIAWFEMDLQEYKGKGNPEVEALFDEAEAITNELVAYRHN | CD123 | 4.7 |
| 577 | MGSWEEFDKRLDAITRRLMALGGSEAELAEFESTIAWFEWDLQEYKGKGNPEVEALDWEAYAIDYELGAYRHN | CD123 | 4.5 |
| 578 | MGSWYEFDHRLEAIYDRLWALGGSEAELAFFEFDIADFEWDLQSYKGKGNPEVEALFDEAAAIGHELLAYRHN | CD123 | 4.5 |
| 579 | MGSWNEFDDRLLAIWGRLDALGGSEAELAFFEEQIAGFEDELQWYKGKGNPEVEALDQEAEAIEKELWAYRHN | CD123 | 4.1 |
| 580 | MGSWVEFDDRLDAIWERLDALGGSEAELAWFEEQIAVFEHQLQDYKGKGNPEVEALNQEAEAIDLELKAYRHN | CD123 | 5 |
| 581 | MGSWTEFDDRLFAIYWRLDALGGSEAELAWFEEVIAEFENDLQVYKGKGNPEVEALDDEAHAISIELEAYRHN | CD123 | 6.4 |
| 582 | MGSWSEFDQRLEAIWNRLDALGGSEAELADFEREIAYFENQLQWYKGKGNPEVEALNNEAFAIVDELGAYRHN | CD123 | 3.4 |
| 583 | MGSWYEFDERLWAIWERLDALGGSEAELAHFEWVIADFENDLQWYKGKGNPEVEALEFEAEAIVTELHAYRHN | CD123 | 3.6 |
| 584 | MGSWMEFDYRLEAIWMRLIALGGSEAELADFESSIADFEHHLQSYKGKGNPEVEALEWEAFAIGVELDAYRHN | CD123 | 3.1 |
| 585 | MGSWYEFESRLEAIWWRLEALGGSEAELAQFEQYIADFEQHLQWYKGKGNPEVEALDWEADAIWLELQAYRHN | CD123 | 4.4 |
| 586 | MGSWEEFYMRLVAIHMRLRALGGSEAELAVFENYIAEFEEYLQYYKGKGNPEVEALTIEADAIGTELGAYRHN | CD123 | 4.4 |
| 587 | MGSWDEFYYRLVAITHRLHALGGSEAELAWFEDDIAGFEWDLQTYKGKGNPEVEALYKEAGAIGMELTAYRHN | CD123 | 5.4 |
| 588 | MGSWEEFDTRLLAIFGRLGALGGSEAELALFEMLIAKFEDDLQNYKGKGNPEVEALSEEAFAIDHELGAYRHN | CD123 | 6.7 |
| 589 | MGSWREFDQRLWAIDWRLEALGGSEAELAMFEWMIATFEDDLQWYKGKGNPEVEALYREAFAIDWELDAYRHN | CD123 | 3.4 |
| 590 | MGSWEEFHERLDAIDERLEALGGSEAELAFFEDDIASFEDWLQWYKGKGNPEVEALSREADAINFELEAYRHN | CD123 | 4.3 |
| 591 | MGSWNEFYERLEAIDRRLFALGGSEAELALFEWMIADFEDDLQMYKGKGNPEVEALINEAGAIGFELEAYRHN | CD123 | 5.2 |

TABLE 3-continued

Exemplary D-domains

| SEQ ID NO: | D-Domain Sequence | Target | ELISA_avg |
|---|---|---|---|
| 592 | MGSWTEFTQRLEAIVDRLFALGGSEAELAEFENSIADFEWDLQWYKGKGNPEVEALNREAVAIDNELWAYRHN | CD123 | 3.9 |
| 593 | MGSWVEFIMRLDAIYERLDALGGSEAELAEFEWHIADFEDHLQWYKGKGNPEVEALFEEADAIWEELWAYRHN | CD123 | 6.4 |
| 594 | MGSWNEFLLRLDAIEHRLFALGGSEAELAEFEWEIADFEDDLQWYKGKGNPEVEALVEEAEAIDVELVAYRHN | CD123 | 3.2 |
| 595 | MGSWYEFNMRLGAIDDRLQALGGSEAELAWFEDMIAIFEDDLQIYKGKGNPEVEALEQEAAAIHQELWAYRHN | CD123 | 3.8 |
| 596 | MGSWEEFHWRLGAIDARLEALGGSEAELAWFEDGIADFEAILQDYKGKGNPEVEALDSEAVAIHHELWAYRHN | CD123 | 3.3 |
| 597 | MGSWYEFYERLWAIDDRLWALGGSEAELAEFEDSIATFEPSLQMYKGKGNPEVEALVAEAWAIFDELAAYRHN | CD123 | 3.6 |
| 598 | MGSWFEFDQRLDAITFRLWALGGSEAELAEFEDVIALFEYHLQDYKGKGNPEVEALEVEAWAIFHELGAYRHN | CD123 | 3.2 |
| 599 | MGSWSEFWFRLDAIEDRLWALGGSEAELAEFEDNIALFEYSLQHYKGKGNPEVEALVKEANAIDDELGAYRHN | CD123 | 4.5 |
| 600 | MGSWYEFWDRLTAIEHRLWALGGSEAELAYFEDSIAHFEGSLQVYKGKGNPEVEALYKEAEAIEWELEAYRHN | CD123 | 4.4 |
| 601 | MGSWYEFDDRLWAIFDRLFALGGSEAELAFFEDSIAEFEEELQHYKGKGNPEVEALYLEAWAIENELGAYRHN | CD123 | 4.7 |
| 602 | MGSWNEFVERLSAIDHRLWALGGSEAELADFEQQIAEFEIHLQEYKGKGNPEVEALDFEADAIFDELLAYRHN | CD123 | 3.2 |
| 603 | MGSWSEFVDRLDAIFDRLWALGGSEAELAWFEDTIAHFEWNLQEYKGKGNPEVEALNGEADAITDELHAYRHN | CD123 | 5.3 |
| 604 | MGSWAEFDSRLDAIAQRLFALGGSEAELAHFEDFIAQFEYSLQEYKGKGNPEVEALSNEADAIFNELKAYRHN | CD123 | 3.6 |
| 605 | MGSWAEFDSRLIAIFDRLWALGGSEAELAWFEDDIAQFEQHLQAYKGKGNPEVEALRQEADAITFELKAYRHN | CD123 | 3.6 |
| 606 | MGSWTEFEERLEAIWDRLYALGGSEAELAAFEWDIAYFEDGLQEYKGKGNPEVEALFMEAEAIIRELKAYRHN | CD123 | 5.9 |
| 607 | MGSWYEFEDRLAAIWDRLNALGGSEAELAIFEWDIAWFEEGLQEYKGKGNPEVEALKHEASAIQTELFAYRHN | CD123 | 6.4 |
| 608 | MGSWLEFESRLWAIWDRLDALGGSEAELAHFEQDIADFEMSLQEYKGKGNPEVEALIREAEAIETELYAYRHN | CD123 | 3.4 |
| 609 | MGSWMEFEDRLIAIWARLDALGGSEAELAWFEADIADFEESLQEYKGKGNPEVEALIFEAIAINKELMAYRHN | CD123 | 3.7 |
| 610 | MGSWFEFTIRLEAIQDRLDALGGSEAELAWFEWDIAEFEEGLQFYKGKGNPEVEALHTEADAIMNELVAYRHN | CD123 | 3.5 |
| 611 | MGSWYEFVSRLDAIEYRLWALGGSEAELAWFEWDIADFEQGLQFYKGKGNPEVEALAQEANAIGSELTAYRHN | CD123 | 3.2 |
| 612 | MGSWEEFDYRLYAIQDRLYALGGSEAELAFFEWEIADFEHMLQMYKGKGNPEVEALFQEADAIDAELHAYRHN | CD123 | 4.4 |
| 613 | MGSWIEFFHRLDAIQDRLDALGGSEAELAYFEWAIADFEHMLQLYKGKGNPEVEALQFEAFAIEGELYAYRHN | CD123 | 3.5 |
| 614 | MGSWYEFSSRLNAIDDRLWALGGSEAELAYFETDIADFESLLQWYKGKGNPEVEALLNEADAIDYELYAYRHN | CD123 | 3.8 |
| 615 | MGSWFEFEYRLDAIIDRLFALGGSEAELAEFESMIANFEYSLQEYKGKGNPEVEALYFEADAIVDELTAYRHN | CD123 | 4 |
| 616 | MGSWLEFEYRLDAIYDRLFALGGSEAELAAFEQDIADFEKYLQYYKGKGNPEVEALWEEADAIMWELFAYRHN | CD123 | 3.1 |

TABLE 3-continued

Exemplary D-domains

| SEQ ID NO: | D-Domain Sequence | Target | ELISA_avg |
|---|---|---|---|
| 617 | MGSWHEFEERLMAIEDRLWALGGSEAELAEFEQWIALFEYDLQEYKGKGNPEVEALGMEAFAINNELSAYRHN | CD123 | 5.8 |
| 618 | MGSWYEFEERLDAIEDRLIALGGSEAELAIFEDIIAFFEQDLQYYKGKGNPEVEALEMEAEAISIELDAYRHN | CD123 | 4.1 |
| 619 | MGSWHEFEKRLYAIEDRLIALGGSEAELAWFEDSIAWFEWDLQMYKGKGNPEVEALNEEADAIYQELDAYRHN | CD123 | 3.6 |
| 620 | MGSWIEFEDRLDAITDRLWALGGSEAELAEFEHQIAFFEEDLQWYKGKGNPEVEALHMEAEAIMEELGAYRHN | CD123 | 9.5 |
| 621 | MGSWMEFEDRLMAIVDRLWALGGSEAELADFEWNIAMFEEELQWYKGKGNPEVEALGDEAEAIEWELYAYRHN | CD123 | 6.8 |
| 622 | MGSWEEFEDRLFAIDSRLWALGGSEAELAEFENIIASFEEVLQEYKGKGNPEVEALSVEAFAIDRELGAYRHN | CD123 | 3.7 |
| 623 | MGSWEEFLFRLEAIQDRLWALGGSEAELAWFEYEIASFEDVLQSYKGKGNPEVEALSTEAKAIDYELFAYRHN | CD123 | 8.2 |
| 624 | MGSWVEFDNRLFAIDERLWALGGSEAELAWFEEEIASFEDNLQKYKGKGNPEVEALQLEAFAIMEELDAYRHN | CD123 | 3.3 |
| 625 | MGSWFEFDDRLEAIFDRLWALGGSEAELAMFEFAIAEFEDALQEYKGKGNPEVEALYEEAVAIDEELYAYRHN | CD123 | 4.1 |
| 626 | MGSWFEFDARLMAINDRLWALGGSEAELAAFEYHIALFEDQLQMYKGKGNPEVEALTLEAVAINEELWAYRHN | CD123 | 4 |
| 627 | MGSWVEFDSRLAAIDYRLEALGGSEAELAWFEYTIANFEHTLQMYKGKGNPEVEALVYEAHAIATELQAYRHN | CD123 | 3.4 |
| 628 | MGSWTEFDERLDAIDWRLEALGGSEAELAWFEGDIALFEQYLQVYKGKGNPEVEALMEEADAIKAELDAYRHN | CD123 | 4.5 |
| 629 | MGSWIEFDERLDAIDFRLWALGGSEAELAWFEGWIAEFESDLQLYKGKGNPEVEALNEEANAIFHELSAYRHN | CD123 | 7 |
| 630 | MGSWWEFDSRLDAIDFRLWALGGSEAELAWFEVEIADFEDWLQLYKGKGNPEVEALWHEADAIVTELYAYRHN | CD123 | 3.2 |
| 631 | MGSWYEFDERLDAIFDRLWALGGSEAELAYFEQVIATFEKTLQRYKGKGNPEVEALDTEAKAISWELDAYRHN | CD123 | 3 |
| 632 | MGSWYEFQERLDAIDSRLWALGGSEAELAWFEYTIAEFEKELQMYKGKGNPEVEALGTEAVAISEELMAYRHN | CD123 | 5.5 |
| 633 | MGSWEEFEDRLWAIDGRLYALGGSEAELAWFEQWIATFEEDLQDYKGKGNPEVEALEYEASAIFEELEAYRHN | CD123 | 9.4 |
| 634 | MGSWFEFGDRLEAIDERLYALGGSEAELAQFEWWIAEFEHHLQDYKGKGNPEVEALEYEADAIWGELHAYRHN | CD123 | 4.5 |
| 635 | MGSWFEFNDRLDAISERLSALGGSEAELAYFEWQIAVFEKTLQNYKGKGNPEVEALTLEANAIFEELEAYRHN | CD123 | 3.9 |
| 636 | MGSWVEFMDRLEAIEERLSALGGSEAELAFFEWEIAEFEEHLQVYKGKGNPEVEALEWEALAITEELAAYRHN | CD123 | 4 |
| 637 | MGSWIEFMDRLWAIDQRLWALGGSEAELAWFEEEIAWFEEELQVYKGKGNPEVEALEWEATAISEELWAYRHN | CD123 | 6.5 |
| 638 | MGSWEEFNWRLRAIDERLFALGGSEAELAWFEYDIAEFEEQLQVYKGKGNPEVEALRVEAAAIAEELYAYRHN | CD123 | 5.4 |
| 639 | MGSWWEFEIRLDAIDERLWALGGSEAELAWFEQSIAFFENDLQVYKGKGNPEVEALRWEANAIIEELFAYRHN | CD123 | 3.2 |
| 640 | MGSWYEFEWRLDAIDRRLWALGGSEAELADFEEEIADFEWMLQNYKGKGNPEVEALVDEASAIQTELWAYRHN | CD123 | 10 |
| 641 | MGSWYEFVYRLRAIDERLDALGGSEAELAMFEFEIAFFEDQLQRYKGKGNPEVEALVDEAQAIDFELFAYRHN | CD123 | 4.5 |

TABLE 3-continued

Exemplary D-domains

| SEQ ID NO: | D-Domain Sequence | Target | ELISA_avg |
|---|---|---|---|
| 642 | MGSWWEFEDRLYAIDDRLWALGGSEAELAQFEREIAQFEIWLQEYKGKGNPEVEALDDEATAINSELFAYRHN | CD123 | 5.5 |
| 643 | MGSWDEFEFRLEAIDSRLWALGGSEAELAVFEYEIAQFEFMLQEYKGKGNPEVEALGMEAWAIENELFAYRHN | CD123 | 3.6 |
| 644 | MGSWEEFEWRLDAIDERLWALGGSEAELATFEYEIAIFENELQQYKGKGNPEVEALDSEAYAIERELGAYRHN | CD123 | 4.3 |
| 645 | MGSWYEFFDRLDAIDERLWALGGSEAELAWFEAEIAEFEMELQGYKGKGNPEVEALDVEAHAIEMELFAYRHN | CD123 | 3.7 |
| 646 | MGSWYEFMGRLEAIDERLQALGGSEAELAWFEHEIAEFEWSLQWYKGKGNPEVEALRFEAGAIPWELWAYRHN | CD123 | 3.5 |
| 647 | MGSWVEFSNRLDAIWERLQALGGSEAELAYFEWEIAEFEWELQSYKGKGNPEVEALNAEADAIEWELEAYRHN | CD123 | 5.1 |
| 648 | MGSWEEFHMRLIAIDERLWALGGSEAELAGFEESIAYFESQLQDYKGKGNPEVEALDYEAHAIWRELYAYRHN | CD123 | 3.9 |
| 649 | MGSWWEFKYRLDAICFRLAALGGSEAELASFEDEIAYFEEDLQGYKGKGNPEVEALDYEALAIWDELAAYRHN | CD123 | 3.1 |
| 650 | MGSWDEFAMRLEAIQARLFALGGSEAELAIFEDEIAFFETMLQDYKGKGNPEVEALEYEAAAIEAELGAYRHN | CD123 | 3.7 |
| 651 | MGSWWEFNARLDAIEDRLMALGGSEAELAYFEDIIASFENILQQYKGKGNPEVEALWYEAYAIEKELNAYRHN | CD123 | 3.4 |
| 652 | MGSWIEFWNRLEAIEERLYALGGSEAELAYFEDEIAEFEIYLQQYKGKGNPEVEALKHEAEAINKELMAYRHN | CD123 | 5.2 |
| 653 | MGSWNEFVIRLFAIDDRLYALGGSEAELAWFEDEIATFEYELQRYKGKGNPEVEALEYEAEAIVSELFAYRHN | CD123 | 3.5 |
| 654 | MGSWYEFLARLYAIDERLWALGGSEAELATFEHWIADFEEQLQSYKGKGNPEVEALTDEAVAIGEELSAYRHN | CD123 | 4.5 |
| 655 | MGSWLEFETRLHAIDERLWALGGSEAELAEFEEHIAWFEEDLQFYKGKGNPEVEALDFEADAIGWELWAYRHN | CD123 | 4.6 |
| 656 | MGSWFEFETRLEAIDLRLWALGGSEAELATFEDVIAFFEDWLQFYKGKGNPEVEALKMEAWAIGEELHAYRHN | CD123 | 6.6 |
| 657 | MGSWHEFWQRLEAIEGRLWALGGSEAELADFESLIADFEEQLQEYKGKGNPEVEALMAEAEAIDNELRAYRHN | CD123 | 7 |
| 658 | MGSWYEFQRLEAIEWRLGALGGSEAELATFEEDIADFEEWLQEYKGKGNPEVEALQYEAYAIAEELHAYRHN | CD123 | 4.4 |
| 659 | MGSWYEFENRLFAIEERLWALGGSEAELAWFEYEIANFEWGLQSYKGKGNPEVEALDNEAEAIDIELAAYRHN | CD123 | 3.3 |
| 660 | MGSWYEFQRLGAIEERLWALGGSEAELAAFEDIIAYFEYQLQSYKGKGNPEVEALDEEAWAIDDELWAYRHN | CD123 | 10.6 |
| 661 | MGSWWEFEQRLDAIETRLWALGGSEAELAYFEHIIADFEDELQIYKGKGNPEVEALGWEAFAIDGELTAYRHN | CD123 | 4.7 |
| 662 | MGSWFEFPYRLEAIEERLYALGGSEAELAQFEQFIAWFEMDLQDYKGKGNPEVEALWFEANAIVEELDAYRHN | CD123 | 3.1 |
| 663 | MGSWVEFYDRLEAIEIRLWALGGSEAELADFESFIAHFEDDLQAYKGKGNPEVEALMDEANAIVFELDAYRHN | CD123 | 4 |
| 664 | MGSWVEFWDRLDAIEERLWALGGSEAELAEFEFMIAMFEQHLQEYKGKGNPEVEALIPEAGAIDKELTAYRHN | CD123 | 10 |
| 665 | MGSWDEFDARLWAIEERLWALGGSEAELAEFEFMIAAFEDVLQEYKGKGNPEVEALMGEANAIVMELDAYRHN | CD123 | 4.3 |
| 666 | MGSWYEFWRRLDAIEERLWALGGSEAELAMFETDIAGFEWMLQLYKGKGNPEVEALEHEAWAINSELDAYRHN | CD123 | 3.6 |

TABLE 3-continued

Exemplary D-domains

| SEQ ID NO: | D-Domain Sequence | Target | ELISA_avg |
|---|---|---|---|
| 667 | MGSWHEFIWRLDAIEERLWALGGSEAELAWFETEIATFEAQLQDYKGKGNPEVEALEWEAIAIAWELDAYRHN | CD123 | 3.3 |
| 668 | MGSWYEFYWRLEAIEERLWALGGSEAELAEFEKAIATFEDQLQTYKGKGNPEVEALETEALAIHAELEAYRHN | CD123 | 3.7 |
| 669 | MGSWFEFQWRLEAIEDRLWALGGSEAELAEFETIIAGFEEQLQVYKGKGNPEVEALEEEAMAIQTELHAYRHN | CD123 | 3.4 |
| 670 | MGSWWEFEDRLWAIEQRLDALGGSEAELAVFENSIAKFEDMLQVYKGKGNPEVEALHEEADAIIWELYAYRHN | CD123 | 4.4 |
| 671 | MGSWWEFEDRLWAIDRRLMALGGSEAELAVFEQMIAHFEQILQVYKGKGNPEVEALHFEAHAIGMELAAYRHN | CD123 | 4.6 |
| 672 | MGSWWEFLDRLEAIEYRLQALGGSEAELAVFEWEIAMFEDHLQGYKGKGNPEVEALHSEAHAIISELSAYRHN | CD123 | 3.1 |
| 673 | MGSWAEFEDRLAAIERRLEALGGSEAELADFESSIAWFEPDLQYYKGKGNPEVEALMYEAEAIFSELYAYRHN | CD123 | 4.2 |
| 674 | MGSWWEFYDRLTAIEARLWALGGSEAELADFEEGIADFEYDLQDYKGKGNPEVEALFWEAWAIQSELTAYRHN | CD123 | 3.2 |
| 675 | MGSWYEFEDRLAAIEARLWALGGSEAELADFEEEIAYFEHGLQWYKGKGNPEVEALESEAMAIIDELHAYRHN | CD123 | 3.8 |
| 676 | MGSWWEFSWRLEAIETRLDALGGSEAELAFFEMDIAWFEQDLQLYKGKGNPEVEALEEEAYAIYEELEAYRHN | CD123 | 3.3 |
| 677 | MGSWEEFFFRLEAIDDRLYALGGSEAELALFEEVIAYFEQDLQWYKGKGNPEVEALYVEAYAIQEELYAYRHN | CD123 | 3.2 |
| 678 | MGSWFEFEERLNAISWRLHALGGSEAELAYFEEDIAWFEDDLQFYKGKGNPEVEALENEAYAIWEELDAYRHN | CD123 | 13 |
| 679 | MGSWFEFEERLEAIIYRLWALGGSEAELAMFEESIAWFESDLQQYKGKGNPEVEALEYEAMAISKELKAYRHN | CD123 | 3.7 |
| 680 | MGSWAEFDDRLEAIEYRLHALGGSEAELAWFEEGIAGFEHALQSYKGKGNPEVEALETEAGAINEELWAYRHN | CD123 | 5.8 |
| 681 | MGSWDEFEERLQAIEYRLWALGGSEAELAWFEEVIAQFEYDLQKYKGKGNPEVEALSTEAQAIQDELWAYRHN | CD123 | 3.8 |
| 682 | MGSWWEFTDRLDAIFDRLWALGGSEAELAAFEESIAIFEQDLQYYKGKGNPEVEALEYEANAIQYELEAYRHN | CD123 | 7.5 |
| 683 | MGSWWEFTDRLEAIEDRLWALGGSEAELAHFEDSIAQFEQELQWYKGKGNPEVEALADEADAIESELHAYRHN | CD123 | 16.6 |
| 684 | MGSWVEFFWRLDAIEDRLWALGGSEAELANFEFEIADFEAWLQKYKGKGNPEVEALHSEADAIQLELRAYRHN | CD123 | 4 |
| 685 | MGSWVEFYNRLDAIENRLWALGGSEAELAFFEELIAQFEFALQDYKGKGNPEVEALEDEADAIWEELMAYRHN | CD123 | 6.9 |
| 686 | MGSWEEFYYRLHAIDNRLWALGGSEAELAYFEWHIADFELELQDYKGKGNPEVEALSEEATAIFEELWAYRHN | CD123 | 3 |
| 687 | MGSWREFHDRLFAIDGRLWALGGSEAELANFEWDIADFEFELQDYKGKGNPEVEALSWEADAIMQELGAYRHN | CD123 | 5.6 |
| 688 | MGSWEEFDERLWAISDRLWALGGSEAELAYFEGEIAYFEQNLQTYKGKGNPEVEALQTEALAIDTELWAYRHN | CD123 | 6.5 |
| 689 | MGSWEEFEQRLWAIDDRLWALGGSEAELAFFEYEIAEFEMDLQWYKGKGNPEVEALFYEAHAINEELWAYRHN | CD123 | 5.7 |
| 690 | MGSWDEFHQRLAAIGDRLWALGGSEAELAYFEWEIATFEWDLQVYKGKGNPEVEALYFEATAIDEELMAYRHN | CD123 | 3.7 |
| 691 | MGSWVEFEYRLDAISDRLWALGGSEAELAFFENEIASFESDLQFYKGKGNPEVEALMFEAEAIDDELHAYRHN | CD123 | 6.5 |

TABLE 3-continued

Exemplary D-domains

| SEQ ID NO: | D-Domain Sequence | Target | ELISA_avg |
|---|---|---|---|
| 692 | MGSWDEFDTRLDAIFSRLYALGGSEAELAMFEGEIAEFEGSLQHYKGKGNPEVEALDFEAHAIDEELWAYRHN | CD123 | 4 |
| 693 | MGSWHEFDDRLDAIMSRLDALGGSEAELATFEAEIATFEFVLQLYKGKGNPEVEALLAEAYAIDWELEAYRHN | CD123 | 7.7 |
| 694 | MGSWYEFFDRLDAIYDRLYALGGSEAELASFEAQIAEFEVELQSYKGKGNPEVEALEWEAWAIDEELYAYRHN | CD123 | 4.7 |
| 695 | MGSWFEFLYRLDAIEDRLWALGGSEAELAEFEQEIAKFESELQSYKGKGNPEVEALEWEAHAIDMELEAYRHN | CD123 | 6.6 |
| 696 | MGSWLEFEDRLVAIDHRLFALGGSEAELAEFEEEIALFESYLQDYKGKGNPEVEALNWEADAIHAELYAYRHN | CD123 | 3.9 |
| 697 | MGSWYEFESRLDAIVDRLWALGGSEAELAEFEYEIAKFEWELQDYKGKGNPEVEALNWEAGAIEFELYAYRHN | CD123 | 5.1 |
| 698 | MGSWYEFEDRLDAILYRLLALGGSEAELAWFERDIAFFESELQWYKGKGNPEVEALEWEAMAIDDELFAYRHN | CD123 | 4.3 |
| 699 | MGSWGEFMDRLEAIDYRLWALGGSEAELAWFESDIAEFEQELQMYKGKGNPEVEALWDEAMAIRDELFAYRHN | CD123 | 4.6 |
| 700 | MGSWEEFDDRLDAIEHRLWALGGSEAELADFEGSIAAFESWLQVYKGKGNPEVEALEAEAEAIADELWAYRHN | CD123 | 4 |
| 701 | MGSWYEFADRLDAIMDRLVALGGSEAELAYFEWEIAAFEEFLQMYKGKGNPEVEALDEEAEAIKDELMAYRHN | CD123 | 3.3 |
| 702 | MGSWNEFWERLDAIEWRLFALGGSEAELAFFELDIAWFEEELQWYKGKGNPEVEALIFEAHAITLELDAYRHN | CD123 | 3 |
| 703 | MGSWYEFDARLDAIEERLYALGGSEAELAAFEFEIAGFEEALQWYKGKGNPEVEALLKEAEAITDELYAYRHN | CD123 | 8.9 |
| 704 | MGSWDEFSERLDAIWGRLEALGGSEAELATFEFHIAEFEHELQYYKGKGNPEVEALQGEAAAIINELYAYRHN | CD123 | 3.2 |
| 705 | MGSWDEFWDRLDAIEDRLFALGGSEAELADFERVIAWFENDLQEYKGKGNPEVEALDNEADAIRIELHAYRHN | CD123 | 3.9 |
| 706 | MGSWDEFDDRLEAIVDRLFALGGSEAELAMFEFEIAQFEHQLQYYKGKGNPEVEALRDEADAIWIELDAYRHN | CD123 | 5.6 |
| 707 | MGSWEEFTIRLGAIYWRLFALGGSEAELANFEWFIAEFEYELQPYKGKGNPEVEALVIEANAIDGELQAYRHN | CD123 | 3.3 |
| 708 | MGSWFEFEWRLDAIENRLNALGGSEAELAWFEYHIAAFEDSLQHYKGKGNPEVEALEWEAHAIQSELQAYRHN | CD123 | 3.3 |
| 709 | MGSWYEFDDRLEAIWDRLGALGGSEAELAAFEKEIAAFESELQAYKGKGNPEVEWLRETAADIRAELQAYRHN | CD123 | 3.3 |
| 710 | MGSWGEFWARLEAIWIRLDALGGSEAELAAFEKEIAAFESELQAYKGKGNPEVEWLREEAADIRRSLQAYRHN | CD123 | 15 |
| 711 | MGSWIEFEVRLDAIWDRLFALGGSEAELAAFEKEIAAFESELQAYKGKGNPEVEYLRDEAADIRQSLQAYRHN | CD123 | 4.2 |
| 712 | MGSWTEFDRRLDAIWDRLFALGGSEAELAAFEKEIAAFESELQAYKGKGNPEVEWLREEAADIRDYLQAYRHN | CD123 | 9.2 |
| 713 | MGSWTEFDMRLDAIWDRLFALGGSEAELAAFEKEIAAFESELQAYKGKGNPEVEELREEAATIRGVLQAYRHN | CD123 | 3.1 |
| 714 | MGSWEEFHDRLMAIETRLWALGGSEAELAAFEKEIAAFESELQAYKGKGNPEVEWLRYEAADIRDYLQAYRHN | CD123 | 4.3 |
| 715 | MGSWVEFRDRLDAIETRLWALGGSEAELAAFEKEIAAFESELQAYKGKGNPEVEWLRYEAAEIRMVLQAYRHN | CD123 | 4.2 |
| 716 | MGSWMEFIDRLDAIEHRLWALGGSEAELAAFEKEIAAFESELQAYKGKGNPEVEFLREEAAEIRMYLQAYRHN | CD123 | 4.3 |

TABLE 3-continued

Exemplary D-domains

| SEQ ID NO: | D-Domain Sequence | Target | ELISA_avg |
|---|---|---|---|
| 717 | MGSWTEFVWRLDAIEWRLEALGGSEAELAAFEKEIAAFESELQAYKGKGNPEVEFLREEAAEIRDWLQAYRHN | CD123 | 4.2 |
| 718 | MGSWVEFYDRLYAIEVRLLALGGSEAELAAFEKEIAAFESELQAYKGKGNPEVEFLRQEAAEIRDWLQAYRHN | CD123 | 5.8 |
| 719 | MGSWYEFYDRLDAIEWRLWALGGSEAELAAFEKEIAAFESELQAYKGKGNPEVEWLRDEAAQIRDFLQAYRHN | CD123 | 6.2 |
| 720 | MGSWVEFYDRLDAIEHRLDALGGSEAELAAFEKEIAAFESELQAYKGKGNPEVEWLRDEAAFIRDMLQAYRHN | CD123 | 3.4 |
| 721 | MGSWFEFVDRLTAIQVRLWALGGSEAELAAFEKEIAAFESELQAYKGKGNPEVEYLREEAALIRYSLQAYRHN | CD123 | 5.1 |
| 722 | MGSWFEFLDRLDAIEERLWALGGSEAELAAFEKEIAAFESELQAYKGKGNPEVEWLREEAAVIRDSLQAYRHN | CD123 | 12.2 |
| 723 | MGSWYEFMVRLDAIEERLFALGGSEAELAAFEKEIAAFESELQAYKGKGNPEVEFLREEAASIRYHLQAYRHN | CD123 | 4.1 |
| 724 | MGSWYEFEDRLDAIQWRLWALGGSEAELAAFEKEIAAFESELQAYKGKGNPEVEFLRESAANIRQHLQAYRHN | CD123 | 6.3 |
| 725 | MGSWSEFEYRLFAIENRLDALGGSEAELAAFEKEIAAFESELQAYKGKGNPEVEFLREEAAMIRQLLQAYRHN | CD123 | 3.2 |
| 726 | MGSWVEFEYRLDAITERLLALGGSEAELAAFEKEIAAFESELQAYKGKGNPEVEILREEAAFIRQWLQAYRHN | CD123 | 3.9 |
| 727 | MGSWWEFLDRLDAIEMRLFALGGSEAELAAFEKEIAAFESELQAYKGKGNPEVEYLREEAALIRNMLQAYRHN | CD123 | 9 |
| 728 | MGSWWEFEDRLDAIEYRLFALGGSEAELAAFEKEIAAFESELQAYKGKGNPEVEFLREEAAFIRIFLQAYRHN | CD123 | 4.9 |
| 729 | MGSWWEFESRLDAIFMRLTALGGSEAELAAFEKEIAAFESELQAYKGKGNPEVEDLREDAAFIREFLQAYRHN | CD123 | 3.7 |
| 730 | MGSWVEFWHRLDAIKARLNALGGSEAELAAFEKEIAAFESELQAYKGKGNPEVEDLRWYAADFRLILQAYRHN | CD123 | 3.5 |
| 731 | MGSWYEFYNRLSAIYARLQALGGSEAELAAFEKEIAAFESELQAYKGKGNPEVEDLRWYAADIRYMLQAYRHN | CD123 | 10.6 |
| 732 | MGSWYEFYDRLSAIYARLQALGGSEAELAAFEKEIAAFESELQAYKGKGNPEVEDLRWYAADIRYMLQAYRHN | CD123 | 5.3 |
| 733 | MGSWNEFYDRLSAIYFRLQALGGSEAELAAFEKEIAAFESELQAYKGKGNPEVEHLRWYAADIRMILQAYRHN | CD123 | 10.6 |
| 734 | MGSWNEFYDRLSAIYFRLQALGGFEAELAAFEKEIAAFESELQAYKGKGNPEVEHLRWYAADIRMILQAYRHN | CD123 | 9 |
| 735 | MGSWEEFYDRLGAIFARLHALGGSEAELAAFEKEIAAFESELQAYKGKGNPEVEDLRWYAADIRMILQAYRHN | CD123 | 3.9 |
| 736 | MGSWVEFYDRLHAIYFRLLALGGSEAELAAFEKEIAAFESELQAYKGKGNPEVEDLRWYAADIRLVLQAYRHN | CD123 | 4.8 |
| 737 | MGSWKEFDNRLYAIEDRLRALGGSEAELAAFEKEIAAFESELQAYKGKGNPEVEHLRWYAADIRMILQAYRHN | CD123 | 3.9 |
| 738 | MGSWVEFWDRLWAIEDRLWALGGSEAELAAFEKEIAAFESELQAYKGKGNPEVEHLRHYAADIRVWLQAYRHN | CD123 | 4.5 |
| 739 | MGSWYEFADRLWAIEDRLWALGGSEAELAAFEKEIAAFESELQAYKGKGNPEVEFLRYYAADIRWVLQAYRHN | CD123 | 4 |
| 740 | MGSWYEFEERLYAIEDRLYALGGSEAELAAFEKEIAAFESELQAYKGKGNPEVEFLRQEAADIRLMLQAYRHN | CD123 | 11.5 |
| 741 | MGSWTEFEWRLYAIEDRLMALGGSEAELAAFEKEIAAFESELQAYKGKGNPEVEFLRDEAADIRQYLQAYRHN | CD123 | 4.2 |

TABLE 3-continued

Exemplary D-domains

| SEQ ID NO: | D-Domain Sequence | Target | ELISA_avg |
|---|---|---|---|
| 742 | MGSWIEFESRLWAIEDRLLALGGSEAELAAFEKEIAAFESELQAYKGKGNPEVEFLRLEAADIREDLQAYRHN | CD123 | 8.7 |
| 743 | MGSWFEFEDRLDAIWDRLWALGGSEAELAAFEKEIAAFESELQAYKGKGNPEVEFLRMDAAMIRYILQAYRHN | CD123 | 5.1 |
| 744 | MGSWEEFEDRLWAIEDRLWALGGSEAELAAFEKEIAAFESELQAYKGKGNPEVEILRYDAAYIREILQAYRHN | CD123 | 4.1 |
| 745 | MGSWIEFEDRLYAIEDRLWALGGSEAELAAFEKEIAAFESELQAYKGKGNPEVEFLRYEAAEIRYWLQAYRHN | CD123 | 4 |
| 746 | MGSWYEFWDRLEAIEDRLWALGGSEAELAAFEKEIAAFESELQAYKGKGNPEVEFLRYSAAEIRYQLQAYRHN | CD123 | 4.2 |
| 747 | MGSWVEFESRLAAIEHRLWALGGSEAELAAFEKEIAAFESELQAYKGKGNPEVEELREYAAEIRDWLQAYRHN | CD123 | 3.7 |
| 748 | MGSWWEFEHRLFAIEDRLWALGGSEAELAAFEKEIAAFESELQAYKGKGNPEVEFLRDYAAEIRDYLQAYRHN | CD123 | 7.6 |
| 749 | MGSWYEFDSRLMAIEDRLWALGGSEAELAAFEKEIAAFESELQAYKGKGNPEVEYLRQEAAEIRMILQAYRHN | CD123 | 3.2 |
| 750 | MGSWYEFEWRLMAIEDRLWALGGSEAELAAFEKEIAAFESELQAYKGKGNPEVEYLRHEAAEIRDVLQAYRHN | CD123 | 3.4 |
| 751 | MGSWYEFYNRLDAIEDRLWALGGSEAELAAFEKEIAAFESELQAYKGKGNPEVEYLRQEAADIRGQLQAYRHN | CD123 | 11.3 |
| 752 | MGSWWEFHDRLEAIEDRLWALGGSEAELAAFEKEIAAFESELQAYKGKGNPEVEYLRIEAADIRRQLQAYRHN | CD123 | 6.4 |
| 753 | MGSWYEFWDRLEAIEERLWALGGSEAELAAFEKEIAAFESELQAYKGKGNPEVEYLRLEAADIRRILQAYRHN | CD123 | 4.6 |
| 754 | MGSWYEFEERLWAIEERLYALGGSEAELAAFEKEIAAFESELQAYKGKGNPEVEYLRYEAAWIRDFLQAYRHN | CD123 | 5.4 |
| 755 | MGSWYEFENRLEAIEERLWALGGSEAELAAFEKEIAAFESELQAYKGKGNPEVEMLREEAAFIRDWLQAYRHN | CD123 | 6.1 |
| 756 | MGSWYEFEYRLEAIEDRLWALGGSEAELAAFEKEIAAFESELQAYKGKGNPEVEYLREEAAWIRVWLQAYRHN | CD123 | 6.2 |
| 757 | MGSWYEFENRLGAIGDRLWALGGSEAELAAFEKEIAAFESELQAYKGKGNPEVEWLRDEAAYIRAVLQAYRHN | CD123 | 4.8 |
| 758 | MGSWYEFEHRLDAIYDRLWALGGSEAELAAFEKEIAAFESELQAYKGKGNPEVEWLREEAAWIRLWLQAYRHN | CD123 | 6.3 |
| 759 | MGSWYEFEWRLDAIYDRLGALGGSEAELAAFEKEIAAFESELQAYKGKGNPEVEWLREDAAEIRALLQAYRHN | CD123 | 6 |
| 760 | MGSWVEFENRLEAIENRLWALGGSEAELAAFEKEIAAFESELQAYKGKGNPEVEWLREDAAQIRMMLQAYRHN | CD123 | 6.2 |
| 761 | MGSWYEFEERLEAIEDRLWALGGSEAELAAFEKEIAAFESELQAYKGKGNPEVEWLREQAAFIRTMLQAYRHN | CD123 | 6 |
| 762 | MGSWFEFEWRLEAIFDRLYALGGSEAELAAFEKEIAAFESELQAYKGKGNPEVEVLRAEAAEIRLRLQAYRHN | CD123 | 6.9 |
| 763 | MGSWWEFEDRLMAIYDRLYALGGSEAELAAFEKEIAAFESELQAYKGKGNPEVEYLRAEAALIRETLQAYRHN | CD123 | 15.3 |
| 764 | MGSWFEFEDRLYAIEDRLYALGGSEAELAAFEKEIAAFESELQAYKGKGNPEVEYLRWGAATIRDELQAYRHN | CD123 | 4.7 |
| 765 | MGSWIEFWDRLEAIEDRLWALGGSEAELAAFEKEIAAFESELQAYKGKGNPEVEELRDEAAWIRDSLQAYRHN | CD123 | 4.5 |
| 766 | MGSWFEFWDRLDAIEDRLYALGGSEAELAAFEKEIAAFESELQAYKGKGNPEVEELRDEAAWIRGTLQAYRHN | CD123 | 4.9 |

TABLE 3-continued

Exemplary D-domains

| SEQ ID NO: | D-Domain Sequence | Target | ELISA_avg |
|---|---|---|---|
| 767 | MGSWEEFTDRLWAIEDRLYALGGSEAELAAFEKEIAAFESELQAYKGKGNPEVEWLRDEAAFIRKSLQAYRHN | CD123 | 8.9 |
| 768 | MGSWVEFVDRLEAIEDRLFALGGSEAELAAFEKEIAAFESELQAYKGKGNPEVEFLRDQAAYIRFMLQAYRHN | CD123 | 4.9 |
| 769 | MGSWFEFVDRLEAIEMRLFALGGSEAELAAFEKEIAAFESELQAYKGKGNPEVELLRWRAAMIRYDLQAYRHN | CD123 | 7.1 |
| 770 | MGSWWEFEMRLEAIEDRLFALGGSEAELAAFEKEIAAFESELQAYKGKGNPEVESLRWEAAFIRDILQAYRHN | CD123 | 4 |
| 771 | MGSWFEFEIRLEAIEDRLFALGGSEAELAAFEKEIAAFESELQAYKGKGNPEVEFLRDEAAEIRQVLQAYRHN | CD123 | 3 |
| 772 | MGSWYEFYQRLEAIEDRLFALGGSEAELAAFEKEIAAFESELQAYKGKGNPEVEWLRDEAAEIRVVLQAYRHN | CD123 | 3 |
| 773 | MGSWIEFEDRLEAIEDRLFALGGSEAELAAFEKEIAAFESELQAYKGKGNPEVEWLRQEAAEIRLMLQAYRHN | CD123 | 21.8 |
| 841 | MGSWVEFYERLDAIDRRLWALGGSEAELAAFEKEIAAFESELQAYKGKGNPEVEELRVHAASIRAWLQAYRHN | P26 | |
| 842 | MGSWFEFYDRLNAIDARLWALGGSEAELAAFEKEIAAFESELQAYKGKGNPEVESLRAHAAAIREWLQAYRHN | P26 | |
| 843 | MGSWSEFYDRLNAIDARLWALGGSEAELAAFEKEIAAFESELQAYKGKGNPEVESLRVHAAAIREWLQAYRHN | P26 | |
| 844 | MGSWSEFYDRLNAIDARLWALGGSEAELAAFEKEIAAFESELQAYKGKGNPEVESLRAHAAAIREWLQAYRHN | P26 | |
| 845 | MGSWSEFYDRLNAIDARLWALGGSEAELAAFEKEIAAFESELQAYKGKGNPEVESLKAHAAAIREWLQAYRHN | P26 | |
| 846 | MGSWSEFYDRLNAIDARLWALGGSEAELAAFEKEIAAFESELQAYKGKGNPEVESLQAHAAAIREWLQAYRHN | P26 | |
| 847 | MGSWSEFYDRLNAIDARLWALGGSEAELAAFEKEIAAFESELQAYKGKGNPEVESLRAHAAGIREWLQAYRHN | P26 | |
| 848 | MGSWFEFYDRLNAIDARLWALGGSEAELAAFEKEIAAFESELQAYKGKGNPEVESLREHAAHIREWLQAYRHN | P26 | |
| 849 | MGSWFEFYDRLNAIDARLWALGGSEAELAAFEKEIAAFESELQAYKGKGNPEVESLREHAAAIREWLQAYRHN | P26 | |
| 850 | MGSWSEFYDRLNAIDARLWALGGSEAELAAFEKEIAAFESELQAYKGKGNPEVESLREHAAAIREWLQAYRHN | P26 | |
| 851 | MGSWHEFYDRLDAIYFRLWALGGSEAELAAFEKEIAAFESELQAYKGKGNPEVELLRLLAAEIRKELQAYRHN | P26 | 9.6 |
| 852 | MGSWHEFITRLEAIDQRLWALGGSEAELAAFEKEIAAFESELQAYKGKGNPEVEYLRFWAAEIRFILQAYRHN | P26 | 16.91 |
| 853 | MGSWMEFFDRLVAIDERLWALGGSEAELAAFEKEIAAFESELQAYKGKGNPEVEYLRMWAAEIRFLLQAYRHN | P26 | 18.62 |
| 854 | MGSWVEFSGRLIAIDNRLWALGGSEAELAAFEKEIAAFESELQAYKGKGNPEVEYLRMWAAEIRYILQAYRHN | P26 | 5.28 |
| 855 | MGSWVEFHHRLFAIDERLWALGGSEAELAAFEKEIAAFESELQAYKGKGNPEVEYLRMVAAEIRYILQAYRHN | P26 | 21.39 |
| 856 | MGSWHEFMERLIAIDGRLWALGGSEAELAAFEKEIAAFESELQAYKGKGNPEVEYLRFVAAFIRDVLQAYRHN | P26 | 17.85 |
| 857 | MGSWKEFIQRLDAIHYRLWALGGSEAELAAFEKEIAAFESELQAYKGKGNPEVEYLRFVAAFIRFELQAYRHN | P26 | 18.41 |
| 858 | MGSWSEFIFRLDAIHSRLQALGGSEAELAAFEKEIAAFESELQAYKGKGNPEVEYLRFIAAEIRLKLQAYRHN | P26 | 28.3 |

TABLE 3-continued

Exemplary D-domains

| SEQ ID NO: | D-Domain Sequence | Target | ELISA_avg |
|---|---|---|---|
| 859 | MGSWFEFYDRLNAIDARLWALGGSEAELAAFEKEIAAFESELQAYKGKGNPEVENLRVHAAAIREWLQAYRHN | P26 | 5.92 |
| 860 | MGSWLEFYDRLNAIDARLWALGGSEAELAAFEKEIAAFESELQAYKGKGNPEVENLRVHAAAIREWLQAYRHN | P26 | |
| 861 | MGSWFEFYHRLNAIDARLWALGGSEAELAAFEKEIAAFESELQAYKGKGNPEVENLRVHAAAIREWLQAYRHN | P26 | |
| 862 | MGSWFEFYDRLNAIDSRLWALGGSEAELAAFEKEIAAFESELQAYKGKGNPEVENLRVHAAAIREWLQAYRHN | P26 | |
| 863 | MGSWFEFYDRLNAIDARLWALGGSEAELAAFEKEIAAFESELQAYKGKGNPEVESLRVHAAAIREWLQAYRHN | P26 | |
| 864 | MGSWFEFYDRLNAIDARLWALGGSEAELAAFEKEIAAFESELQAYKGKGNPEVENLRDHAAAIREWLQAYRHN | P26 | |
| 865 | MGSWFEFYDRLNAIDARLWALGGSEAELAAFEKEIAAFESELQAYKGKGNPEVENLREHAAAIREWLQAYRHN | P26 | |
| 866 | MGSWFEFYDRLNAIDARLWALGGSEAELAAFEKEIAAFESELQAYKGKGNPEVENLRVHAAHIREWLQAYRHN | P26 | |
| 867 | MGSWLEFYHRLNAIDSRLWALGGSEAELAAFEKEIAAFESELQAYKGKGNPEVENLRVHAAAIREWLQAYRHN | P26 | |
| 868 | MGSWLEFYHRLNAIDSRLWALGGSEAELAAFEKEIAAFESELQAYKGKGNPEVESLRDHAAHIREWLQAYRHN | P26 | 19.23 |
| 869 | MGSWFEFYHRLNAIDSRLWALGGSEAELAAFEKEIAAFESELQAYKGKGNPEVESLRDHAAHIREWLQAYRHN | P26 | |
| 870 | MGSWLEFYDRLNAIDSRLWALGGSEAELAAFEKEIAAFESELQAYKGKGNPEVESLRDHAAHIREWLQAYRHN | P26 | |
| 871 | MGSWLEFYHRLNAIDARLWALGGSEAELAAFEKEIAAFESELQAYKGKGNPEVESLRDHAAHIREWLQAYRHN | P26 | |
| 872 | MGSWLEFYHRLNAIDSRLWALGGSEAELAAFEKEIAAFESELQAYKGKGNPEVENLRDHAAHIREWLQAYRHN | P26 | |
| 873 | MGSWLEFYHRLNAIDSRLWALGGSEAELAAFEKEIAAFESELQAYKGKGNPEVESLRVHAAHIREWLQAYRHN | P26 | |
| 874 | MGSWLEFYHRLNAIDSRLWALGGSEAELAAFEKEIAAFESELQAYKGKGNPEVESLRDHAAAIREWLQAYRHN | P26 | |
| 875 | MGSWFEFYDRLNAIDARLWALGGSEAELAAFEKEIAAFESELQAYKGKGNPEVESLRDHAAHIREWLQAYRHN | P26 | |
| 876 | MGSWFEFYERLNAIDSRLWALGGSEAELAAFEKEIAAFESELQAYKGKGNPEVEKLRAHAASIRTWLQAYRHN | P26 | 27.1 |
| 877 | MGSWIEFYWRLEAIDQRLWALGGSEAELAAFEKEIAAFESELQAYKGKGNPEVEDLRVHAAAIRWWLQAYRHN | P26 | 9.4 |
| 878 | MGSWSEFVKRLDAIDQRLWALGGSEAELAAFEKEIAAFESELQAYKGKGNPEVESLRVHAAAIRAWLQAYRHN | P26 | 27 |
| 879 | MGSWEEFYYRLEAIDARLFALGGSEAELAAFEKEIAAFESELQAYKGKGNPEVEELRVHAAHIRDWLQAYRHN | P26 | 30.3 |
| 880 | MGSWVEFHYRLQAIDARLWALGGSEAELAAFEKEIAAFESELQAYKGKGNPEVEELRVHAAHIRKWLQAYRHN | P26 | 14.8 |
| 881 | MGSWVEFVGRLNAIDARLWALGGSEAELAAFEKEIAAFESELQAYKGKGNPEVEELRHHAAEIRNWLQAYRHN | P26 | 26 |
| 882 | MGSWNEFMDRLNAIDNRLWALGGSEAELAAFEKEIAAFESELQAYKGKGNPEVENLRKQAASIRLWLQAYRHN | P26 | 10 |
| 883 | MGSWNEFFQRLNAIDERLWALGGSEAELAAFEKEIAAFESELQAYKGKGNPEVEDLRQHAANIRWWLQAYRHN | P26 | 28.7 |

TABLE 3-continued

Exemplary D-domains

| SEQ ID NO: | D-Domain Sequence | Target | ELISA_avg |
|---|---|---|---|
| 884 | MGSWYEFVVRLFAIDERLWALGGSEAELAAFEKEIAAFESELQAYKGKGNPEVESLREHAAHIRSWLQAYRHN | P26 | 18.25 |
| 885 | MGSWYEFYLRLDAIDHRLWALGGSEAELAAFEKEIAAFESELQAYKGKGNPEVEMLREHAAHIRKWLQAYRHN | P26 | 16 |
| 886 | MGSWYEFRARLLAIDERLWALGGSEAELAAFEKEIAAFESELQAYKGKGNPEVEHLREHAAHIRNFLQAYRHN | P26 | 20.9 |
| 887 | MGSWTEFWHRLEAIDSRLWALGGSEAELAAFEKEIAAFESELQAYKGKGNPEVESLREHAAHIRVWLQAYRHN | P26 | 13.19 |
| 888 | MGSWTEFQNRLNAIDHRLWALGGSEAELAAFEKEIAAFESELQAYKGKGNPEVESLREHAAKIRVWLQAYRHN | P26 | 30.5 |
| 889 | MGSWSEFFKRLEAIDRRLWALGGSEAELAAFEKEIAAFESELQAYKGKGNPEVEELREHAAHIRVWLQAYRHN | P26 | 30.2 |
| 890 | MGSWYEFQQRLEAIDTRLWALGGSEAELAAFEKEIAAFESELQAYKGKGNPEVEELREHAAHIRHWLQAYRHN | P26 | 27.3 |
| 891 | MGSWTEFEKRLHAIDYRLWALGGSEAELAAFEKEIAAFESELQAYKGKGNPEVEDLREHAAAIRHWLQAYRHN | P26 | 17.1 |
| 892 | MGSWTEFHQRLDAIDERLWALGGSEAELAAFEKEIAAFESELQAYKGKGNPEVEFLREHAAKIRMWLQAYRHN | P26 | 24.4 |
| 893 | MGSWLEFSQRLTAIDSRLWALGGSEAELAAFEKEIAAFESELQAYKGKGNPEVENLREHAAKIRNWLQAYRHN | P26 | 30.4 |
| 894 | MGSWTEFVNRLYAIDSRLWALGGSEAELAAFEKEIAAFESELQAYKGKGNPEVEGLRTHAAKIRHWLQAYRHN | P26 | 16.7 |
| 895 | MGSWMEFVDRLSAIDRRLWALGGSEAELAAFEKEIAAFESELQAYKGKGNPEVEVLREHAANIRQWLQAYRHN | P26 | 32.1 |
| 896 | MGSWVEFVSRLYAIDFRLWALGGSEAELAAFEKEIAAFESELQAYKGKGNPEVEALREHAAQIRDWLQAYRHN | P26 | 29 |
| 897 | MGSWSEFHTRLDAIDTRLWALGGSEAELAAFEKEIAAFESELQAYKGKGNPEVEDLRRHAAAIRFWLQAYRHN | P26 | 23.5 |
| 898 | MGSWLEFHSRLDAIDTRLWALGGSEAELAAFEKEIAAFESELQAYKGKGNPEVEKLREHAAAIRHYLQAYRHN | P26 | 30.8 |
| 899 | MGSWTEFYQRLDAIDTRLWALGGSEAELAAFEKEIAAFESELQAYKGKGNPEVEGLRQQAAQIRAWLQAYRHN | P26 | 29.7 |
| 900 | MGSWAEFSDRLNAIDQRLWALGGSEAELAAFEKEIAAFESELQAYKGKGNPEVEILREHAAEIRKFLQAYRHN | P26 | 25.3 |
| 901 | MGSWMEFNHRLQAIDGRLWALGGSEAELAAFEKEIAAFESELQAYKGKGNPEVEMLREHAAAIRAFLQAYRHN | P26 | 33.4 |
| 902 | MGSWYEFYKRLEAIDNRLYALGGSEAELAAFEKEIAAFESELQAYKGKGNPEVEYLREHAAAIRHWLQAYRHN | P26 | 30.8 |
| 903 | MGSWYEFYYRLEAIDNRLIALGGSEAELAAFEKEIAAFESELQAYKGKGNPEVEVLREHAAKIREWLQAYRHN | P26 | 29.6 |
| 904 | MGSWYEFVSRLEAIDDRLYALGGSEAELAAFEKEIAAFESELQAYKGKGNPEVEMLRQHAAAIRHWLQAYRHN | P26 | 33.1 |
| 905 | MGSWYEFSHRLEAIEDRLFALGGSEAELAAFEKEIAAFESELQAYKGKGNPEVEPLREHAAYIRHWLQAYRHN | P26 | 26 |
| 906 | MGSWFEFFERLAAIEDRLWALGGSEAELAAFEKEIAAFESELQAYKGKGNPEVESLRVHAAIRAFLQAYRHN | P26 | 20.3 |
| 907 | MGSWIEFKYRLDAIEWRLEALGGSEAELAAFEKEIAAFESELQAYKGKGNPEVESLRIHAAAIRTWLQAYRHN | P26 | 18.3 |
| 908 | MGSWYEFMYRLDAIEYRLFALGGSEAELAAFEKEIAAFESELQAYKGKGNPEVESLRIHAAMIREWLQAYRHN | P26 | 19.4 |

TABLE 3-continued

Exemplary D-domains

| SEQ ID NO: | D-Domain Sequence | Target | ELISA_avg |
|---|---|---|---|
| 909 | MGSWVEFVTRLEAIEDRLFALGGSEAELAAFEKEIAAFESELQAYKGKGNPEVEHLRAHAAHIRHWLQAYRHN | P26 | 11.7 |
| 910 | MGSWYEFVIRLDAIEDRLFALGGSEAELAAFEKEIAAFESELQAYKGKGNPEVEHLRVHAAHIRVWLQAYRHN | P26 | 30.1 |
| 911 | MGSWVEFVERLDAIEFRLFALGGSEAELAAFEKEIAAFESELQAYKGKGNPEVEKLRNHAAHIRSWLQAYRHN | P26 | 23.8 |
| 912 | MGSWSEFVHRLDAIEVRLFALGGSEAELAAFEKEIAAFESELQAYKGKGNPEVEELRYHAAKIRSWLQAYRHN | P26 | 16.9 |
| 913 | MGSWSEFYYRLAAIESRLFALGGSEAELAAFEKEIAAFESELQAYKGKGNPEVERLREHAAHIRRWLQAYRHN | P26 | 30.8 |
| 914 | MGSWYEFYLRLSAIEDRLFALGGSEAELAAFEKEIAAFESELQAYKGKGNPEVESLRVQAAHIRTWLQAYRHN | P26 | 27.4 |
| 915 | MGSWYEFYDRLDAIEDRLFALGGSEAELAAFEKEIAAFESELQAYKGKGNPEVESLRDQAAYIRTWLQAYRHN | P26 | 31.9 |
| 916 | MGSWHEFWVRLEAIESRLFALGGSEAELAAFEKEIAAFESELQAYKGKGNPEVESLRVQAAHIRSWLQAYRHN | P26 | 26.9 |
| 917 | MGSWVEFYHRLEAIEQRLMALGGSEAELAAFEKEIAAFESELQAYKGKGNPEVESLREQAAIRSWLQAYRHN | P26 | 28.5 |
| 918 | MGSWVEFYERLNAIEYRLEALGGSEAELAAFEKEIAAFESELQAYKGKGNPEVESLREHAAYIRQWLQAYRHN | P26 | 28.7 |
| 919 | MGSWVEFYHRLDAIFDRLDALGGSEAELAAFEKEIAAFESELQAYKGKGNPEVEELRANAAGIRSWLQAYRHN | P26 | 20 |
| 920 | MGSWSEFTDRLFAIEDRLLALGGSEAELAAFEKEIAAFESELQAYKGKGNPEVEDLRMHAASIRLWLQAYRHN | P26 | 25.4 |
| 921 | MGSWHEFYDRLYAIWDRLDALGGSEAELAAFEKEIAAFESELQAYKGKGNPEVEGLRNAAAVIRIFLQAYRHN | P26 | 22.91 |
| 922 | MGSWFEFSNRLYAIWHRLTALGGSEAELAAFEKEIAAFESELQAYKGKGNPEVESLRTQAAFIRILLQAYRHN | P26 | 15.25 |
| 923 | MGSWFEFSDRLYAIWERLDALGGSEAELAAFEKEIAAFESELQAYKGKGNPEVESLRFQAAFIRYQLQAYRHN | P26 | 18.99 |
| 924 | MGSWFEFEDRLFAIWTRLEALGGSEAELAAFEKEIAAFESELQAYKGKGNPEVESLRQSAASIRWLLQAYRHN | P26 | 10.89 |
| 925 | MGSWHEFSERLFAIWTRLEALGGSEAELAAFEKEIAAFESELQAYKGKGNPEVEALRQSAAFIRVMLQAYRHN | P26 | 8.21 |
| 926 | MGSWGEFTVRLYAIDRRLDALGGSEAELAAFEKEIAAFESELQAYKGKGNPEVEELRRFAAIIRAFLQAYRHN | P26 | 8.54 |
| 927 | MGSWYEFDHRLMAISFRLVALGGSEAELAAFEKEIAAFESELQAYKGKGNPEVETLRRRAANIRHLLQAYRHN | P26 | 20.1 |
| 928 | MGSWSIFKYHLADIKLLLEALGGSEAELAYFEFLIADFEFTLQDYKGKGNPEVEALRKEAAAIRDELQAYRHN | P26 | 20.21 |
| 929 | MGSWHHFKYFLADIKSILEALGGSEAELAIFEVQIAYFEDLLQSYKGKGNPEVEALRKEAAAIRDELQAYRHN | P26 | 8 |
| 930 | MGSWLYFKYNLAVIKHWLEALGGSEAELAIFEMSIADFEYELQWYKGKGNPEVEALRKEAAAIRDELQAYRHN | P26 | 13.3 |
| 931 | MGSWFYFKYELAWIKHWLEALGGSEAELASFETHIAFFEHQLQYYKGKGNPEVEALRKEAAAIRDELQAYRHN | P26 | 13.7 |
| 932 | MGSWADFKWTLAYIKHRLEALGGSEAELAFFEMEIAYFEQSLQNYKGKGNPEVEALRKEAAAIRDELQAYRHN | P26 | 31.5 |
| 933 | MGSWAYFKGQLAYIKSGLEALGGSEAELAYFELRIAYFEHWLQNYKGKGNPEVEALRKEAAAIRDELQAYRHN | P26 | 11.4 |

TABLE 3-continued

Exemplary D-domains

| SEQ ID NO: | D-Domain Sequence | Target | ELISA_avg |
|---|---|---|---|
| 934 | MGSWENFKDTLAWIKEYLEALGGSEAELAGFEHRIAIFEHYLQYYKGKGNPEVEALRKEAAAIRDELQAYRHN | P26 | 19.2 |
| 935 | MGSWVLFKDYLADIKHYLEALGGSEAELANFEHLIANFEGDLQTYKGKGNPEVEALRKEAAAIRDELQAYRHN | P26 | 13.8 |
| 936 | MGSWSLFKHRLANIKVYLEALGGSEAELADFETFIAYFEKDLQEYKGKGNPEVEALRKEAAAIRDELQAYRHN | P26 | 19.6 |
| 937 | MGSWEHFKVELAGIKAYLEALGGSEAELALFEWAIADFESILQDYKGKGNPEVEALRKEAAAIRDELQAYRHN | P26 | 18.1 |
| 938 | MGSWIYFKDELAGIKKYLEALGGSEAELAMFEVAIADFEAILQKYKGKGNPEVEALRKEAAAIRDELQAYRHN | P26 | 15.9 |
| 939 | MGSWVLFKQELAWIKWLLEALGGSEAELAAFEEQIARFEHDLQKYKGKGNPEVEALRKEAAAIRDELQAYRHN | P26 | 29.5 |
| 940 | MGSWVLFKQELAWIKWYLEALGGSEAELAAFEWEIAAFEQRLQIYKGKGNPEVEALRKEAAAIRDELQAYRHN | P26 | 22.5 |
| 941 | MGSWFLFKSELAWIKWRLEALGGSEAELAYFEYQIAEFEFWLQSYKGKGNPEVEALRKEAAAIRDELQAYRHN | P26 | 25.8 |
| 942 | MGSWLLFKSELAWIKWYLEALGGSEAELAEFEWNIAEFEKNLQKYKGKGNPEVEALRKEAAAIRDELQAYRHN | P26 | 25.7 |
| 943 | MGSWLLFKSDLAWIKWRLEALGGSEAELAEFEESIAMFEHWLQEYKGKGNPEVEALRKEAAAIRDELQAYRHN | P26 | 33.3 |
| 944 | MGSWLYFKSDLAWIKWRLEALGGSEAELADFEEAIAEFEQALQIYKGKGNPEVEALRKEAAAIRDELQAYRHN | P26 | 21.2 |
| 945 | MGSWKLFKYELAWIKWRLEALGGSEAELADFEASIAQFEKYLQTYKGKGNPEVEALRKEAAAIRDELQAYRHN | P26 | 23.4 |
| 946 | MGSWYLFKNELAWIKWRLEALGGSEAELADFEMVIAMFEDHLQEYKGKGNPEVEALRKEAAAIRDELQAYRHN | P26 | 31.1 |
| 947 | MGSWVYFKAHLAFIKWELEALGGSEAELANFESTIAEFEKYLQVYKGKGNPEVEALRKEAAAIRDELQAYRHN | P26 | 20.8 |
| 948 | MGSWMYFKSHLAWIKWELEALGGSEAELAFFEDNIAQFEYWLQLYKGKGNPEVEALRKEAAAIRDELQAYRHN | P26 | 19.8 |
| 949 | MGSWTLFKWDLAFIKWQLEALGGSEAELAWFEYEIAAFEDSLQNYKGKGNPEVEALRKEAAAIRDELQAYRHN | P26 | 12.1 |
| 950 | MGSWILFKEDLAFIKWQLEALGGSEAELAWFETTIANFESDLQKYKGKGNPEVEALRKEAAAIRDELQAYRHN | P26 | 23.3 |
| 951 | MGSWYFFKSRLAYIKVYLEALGGSEAELAGFEWEIAHFEEWLQRYKGKGNPEVEALRKEAAAIRDELQAYRHN | P26 | 30.1 |
| 952 | MGSWYIFKSELAWIKWYLEALGGSEAELANFEVEIATFETWLQGYKGKGNPEVEALRKEAAAIRDELQAYRHN | P26 | 29.6 |
| 953 | MGSWYIFKQELASIKLSLEALGGSEAELAHFEAEIAWFEWWLQWYKGKGNPEVEALRKEAAAIRDELQAYRHN | P26 | 19.4 |
| 954 | MGSWVRFKTELAYIKESLEALGGSEAELAMFESEIAIFEHSLQTYKGKGNPEVEALRKEAAAIRDELQAYRHN | P26 | 20.5 |
| 955 | MGSWYLFKTELAAIKYRLEALGGSEAELASFEYEIAWFEHILQFYKGKGNPEVEALRKEAAAIRDELQAYRHN | P26 | 20.1 |
| 956 | MGSWYWFKYELAEIKWHLEALGGSEAELAHFEHSIAVFESQLQQYKGKGNPEVEALRKEAAAIRDELQAYRHN | P26 | 21.5 |
| 957 | MGSWWVFKKTLAEIKWTLEALGGSEAELAYFEAEIAFFEFILQQYKGKGNPEVEALRKEAAAIRDELQAYRHN | P26 | 18.6 |
| 958 | MGSWVYFKDHLAEIKSQLEALGGSEAELALFEYDIAWFEFILQYYKGKGNPEVEALRKEAAAIRDELQAYRHN | P26 | 22.1 |

TABLE 3-continued

Exemplary D-domains

| SEQ ID NO: | D-Domain Sequence | Target | ELISA_avg |
|---|---|---|---|
| 959 | MGSWVYFKHRLAEIKDQLEALGGSEAELAEFETDIAWFEWMLQYYKGKGNPEVEALRKEAAAIRDELQAYRHN | P26 | 11.1 |
| 960 | MGSWIIFKTDLARIKNYLEALGGSEAELATFERDIAWFEFMLQIYKGKGNPEVEALRKEAAAIRDELQAYRHN | P26 | 16.7 |
| 961 | MGSWMHFKQDLAEIKGYLEALGGSEAELAIFEMDIAWFEYMLQYYKGKGNPEVEALRKEAAAIRDELQAYRHN | P26 | 18.9 |
| 962 | MGSWQIFKQDLAAIKDYLEALGGSEAELAIFEFDIAWFEHMLQWYKGKGNPEVEALRKEAAAIRDELQAYRHN | P26 | 17.4 |
| 963 | MGSWLAFKEDLAHIKSILEALGGSEAELAEFEHDIAWFEYMLQYYKGKGNPEVEALRKEAAAIRDELQAYRHN | P26 | 18.6 |
| 964 | MGSWFVFKEDLAGIKFILEALGGSEAELAMFETDIAWFEYMLQYYKGKGNPEVEALRKEAAAIRDELQAYRHN | P26 | 14.2 |
| 965 | MGSWTHFKEDLAHIKDRLEALGGSEAELAAFELDIAWFEFMLQYYKGKGNPEVEALRKEAAAIRDELQAYRHN | P26 | 30.4 |
| 966 | MGSWYYFKERLAAIKDRLEALGGSEAELAIFEADIAWFEPMLQYYKGKGNPEVEALRKEAAAIRDELQAYRHN | P26 | 31.5 |
| 967 | MGSWYTFKGSLAEIKNRLEALGGSEAELAMFESDIAWFEFMLQFYKGKGNPEVEALRKEAAAIRDELQAYRHN | P26 | 32.3 |
| 968 | MGSWFTFKDDLAQIKNRLEALGGSEAELANFEMSIAWFEFMLQYYKGKGNPEVEALRKEAAAIRDELQAYRHN | P26 | 30.8 |
| 969 | MGSWVLFKQDLAMIKQRLEALGGSEAELAMFEYDIAWFEHMLQYYKGKGNPEVEALRKEAAAIRDELQAYRHN | P26 | 29.7 |
| 970 | MGSWVEFKRDLANIKQRLEALGGSEAELAQFEMQIAWFEHTLQYYKGKGNPEVEALRKEAAAIRDELQAYRHN | P26 | 30.4 |
| 971 | MGSWSYFKEDLANIKSSLEALGGSEAELAWFESSIAWFEHTLQYYKGKGNPEVEALRKEAAAIRDELQAYRHN | P26 | 11.6 |
| 972 | MGSWSIFKQDLADIKDSLEALGGSEAELAMFEMDIAWFEHTLQYYKGKGNPEVEALRKEAAAIRDELQAYRHN | P26 | 16.6 |
| 973 | MGSWEIFKDDLASIKKVLEALGGSEAELALFESDIAWFELMLQYYKGKGNPEVEALRKEAAAIRDELQAYRHN | P26 | 27.9 |
| 974 | MGSWSIFKDDLAVIKERLEALGGSEAELAHFEQDIAWFEHLLQYYKGKGNPEVEALRKEAAAIRDELQAYRHN | P26 | 25.6 |
| 975 | MGSWSVFKDDLAQIKDRLEALGGSEAELAQFELDIAWFEYVLQFYKGKGNPEVEALRKEAAAIRDELQAYRHN | P26 | 30.3 |
| 976 | MGSWAVFKDSLAHIKDVLEALGGSEAELALFEMDIAWFEYVLQDYKGKGNPEVEALRKEAAAIRDELQAYRHN | P26 | 24.1 |
| 977 | MGSWIAFKDHLAIIKQRLEALGGSEAELARFEFEIAWFEWMLQYYKGKGNPEVEALRKEAAAIRDELQAYRHN | P26 | 29.9 |
| 978 | MGSWIHFKNDLAVIKDELEALGGSEAELARFEIMIAWFEDALQWYKGKGNPEVEALRKEAAAIRDELQAYRHN | P26 | 17.9 |
| 979 | MGSWMVFKQDLAEIKANLEALGGSEAELADFEFAIAWFEYELQWYKGKGNPEVEALRKEAAAIRDELQAYRHN | P26 | 17.8 |
| 980 | MGSWKNFKLELALIKSKLEALGGSEAELAQFEADIAFFEWSLQWYKGKGNPEVEALRKEAAAIRDELQAYRHN | P26 | 20.6 |
| 981 | MGSWHSFKQDLAYIKYLLEALGGSEAELAQFEELIAFFEYYLQTYKGKGNPEVEALRKEAAAIRDELQAYRHN | P26 | 25.6 |
| 982 | MGSWVVFKSSLAQIKILLEALGGSEAELAIFEVKIAHFEQELQEYKGKGNPEVEALRKEAAAIRDELQAYRHN | P26 | 8.6 |
| 983 | MGSWDQFKNSLASIKRVLEALGGSEAELAIFEVKIAHFEHFLQQYKGKGNPEVEALRKEAAAIRDELQAYRHN | P26 | 15.6 |

TABLE 3-continued

Exemplary D-domains

| SEQ ID NO: | D-Domain Sequence | Target | ELISA_avg |
|---|---|---|---|
| 984 | MGSWNNFKSSLASIKQVLEALGGSEAELAVFELQIAHFERELQYYKGKGNPEVEALRKEAAAIRDELQAYRHN | P26 | 24.1 |
| 985 | MGSWVEFGHRLWAIDQRLYALGGSEAELAAFEKEIAAFESELQAYKGKGNPEVEKLRQRAAFIRFRLQAYRHN | CD137 | |
| 986 | MGSWVEFANRLWAIDQRLFALGGSEAELAAFEKEIAAFESELQAYKGKGNPEVEHLRDQAAFIRHKLQAYRHN | CD137 | |
| 987 | MGSWYEFRHRLWAIDQRLYALGGSEAELAAFEKEIAAFESELQAYKGKGNPEVEGLREAAAFIRAKLQAYRHN | CD137 | |
| 988 | MGSWYEFSMRLWAIDQRLYALGGSEAELAAFEKEIAAFESELQAYKGKGNPEVEALRAKAAYIRWKLQAYRHN | CD137 | |
| 989 | MGSWYEFGHRLWAIDQRLYALGGSEAELAAFEKEIAAFESELQAYKGKGNPEVEYLRETAAHIRTRLQAYRHN | CD137 | |
| 990 | MGSWYEFHYRLHAIDQRLYALGGSEAELAAFEKEIAAFESELQAYKGKGNPEVEELRIKAAFIRDRLQAYRHN | CD137 | |
| 991 | MGSWAEFKQRLAAIKTRLEALGGSEAELAAFLGEIWAFEMELAAYKGKGNPEVEALGREAAAIRMELQAYRHN | CD137 | |
| 992 | MGSWYEFDLRLHAIYDRLVALGGSEAELAAFEKEIAAFESELQAYKGKGNPEVEILRDNAAYIRQMLQAYRHN | CD47 | |
| 993 | MGSWTEFTYRLSAIEWRLWALGGSEAELAWFEQKIAFFEDFLQYYKGKGNPEVEALKHEAGAILNELMAYRHN | CD47 | |
| 994 | MGSWAEFDHRLHAIRERLHALGGSEAELAAFEKEIAAFESELQAYKGKGNPEVEILRGNAAYIKALLQAYRHN | CD47 | |
| 995 | MGSWTEFVGRLAAIEFRLWALGGSEAELAWFEAHIAFFEDYLQWYKGKGNPEVEALREEAGAIMEELKAYRHN | CD47 | |
| 996 | MGSWTEFYSRLEAIWVRLQALGGSEAELAMFEDRIAHFEWFLQQYKGKGNPEVEALHEEAIAIRKELAAYRHN | CD47 | |
| 997 | MGSWHEFHDRLQAIHERLYALGGSEAELAAFEKEIAAFESELQAYKGKGNPEVESLRIAAAHIRQVLQAYRHN | CTLA4 | |
| 998 | MGSWNYFKDHLAWIKNSLEALGGSEAELAHFETAIASFERQLQEYKGKGNPEVEALRKEAAAIRDELQAYRHN | DR5 | |
| 999 | MGSWLYFKEHLAHIKAWLEALGGSEAELAHFELAIADFEYHLQEYKGKGNPEVEALRKEAAAIRDELQAYRHN | DR5 | |
| 1000 | MGSWVYFKEHLAWIKTELEALGGSEAELAHFEHSIADFEMSLQFYKGKGNPEVEALRKEAAAIRDELQAYRHN | DR5 | |
| 1001 | MGSWFYFKQHLAWIKSYLEALGGSEAELAHFERAIAAFEQHLQMYKGKGNPEVEALRKEAAAIRDELQAYRHN | DR5 | |
| 1002 | MGSWHYFKDHLAEIKGLLEALGGSEAELAHFEMAIADFEHNLQYYKGKGNPEVEALRKEAAAIRDELQAYRHN | DR5 | |
| 1003 | MGSWHYFKGHLAEIKNHLEALGGSEAELAHFERAIAAFERSLQWYKGKGNPEVEALRKEAAAIRDELQAYRHN | DR5 | |
| 1004 | MGSWIYFKEHLAYIKKELEALGGSEAELAHFESAIAVFESTLQYYKGKGNPEVEALRKEAAAIRDELQAYRHN | DR5 | |
| 1005 | MGSWTYFKEHLAEIKYMLEALGGSEAELAHFEVAIADFEKMLQYYKGKGNPEVEALRKEAAAIRDELQAYRHN | DR5 | |
| 1006 | MGSWWLFKDHLAEIKTALEALGGSEAELAHFEMAIAAFEKQLQYYKGKGNPEVEALRKEAAAIRDELQAYRHN | DR5 | |
| 1007 | MGSWSEFYNRLDAIESRLLALGGSEAELALFEIQIARFEKVLQAYKGKGNPEVEALRGEARAIFAELYAYRHN | KIR | |
| 1008 | MGSWYEFYNRLYAIEIRLYALGGSEAELAAFEKEIAAFESELQAYKGKGNPEVERLRVRAAKIRVILQAYRHN | KIR | |

TABLE 3-continued

Exemplary D-domains

| SEQ ID NO: | D-Domain Sequence | Target | ELISA_avg |
|---|---|---|---|
| 1009 | MGSWLWFKIFLAEIKYFLEALGGSEAELAAFDFEIHAFHVELFAYKGKGNPEVEVLREVAAEIRWDLQAYRHN | KIR | |
| 1010 | MGSWTEFQSRLDAIHSRLRALGGSEAELAAFEKEIAAFESELQAYKGKGNPEVELLRDDAAFIRHFLQAYRHN | PDL1 | |
| 1011 | MGSWQEFDDRLNAIKARLQALGGSEAELAAFEKEIAAFESELQAYKGKGNPEVEDLRDDAAFIRRFLQAYRHN | PDL1 | |
| 1012 | MGSWYEFQNRLHAIHERLNALGGSEAELAAFEKEIAAFESELQAYKGKGNPEVELLRDDAAFIRHFLQAYRHN | PDL1 | |
| 1013 | MGSWFEFQDRLTAINERLSALGGSEAELAAFEKEIAAFESELQAYKGKGNPEVETLRSDAAFIRRFLQAYRHN | PDL1 | |
| 1014 | MGSWYEFESRLDAIHERLHALGGSEAELAAFEKEIAAFESELQAYKGKGNPEVENLRGDAAFIRHFLQAYRHN | PDL1 | |
| 1015 | MGSWYEFNHRLDAISKRLNALGGSEAELAAFEKEIAAFESELQAYKGKGNPEVEELRGDAAFIRHFLQAYRHN | PDL1 | |
| 1016 | MGSWFEFENRLHAIVHRLGALGGSEAELAAFEKEIAAFESELQAYKGKGNPEVETLRADAAFIRHYLQAYRHN | PDL1 | |
| 1017 | MGSWVVFKVDLATIKYILEALGGSEAELAEFEGEIAGFEYSLQFYKGKGNPEVEALRKEAAAIRDELQAYRHN | TIM3 | |
| 1018 | MGSWTIFKEWLAFIKTDLEALGGSEAELAFFEGWIASFEMELQKYKGKGNPEVEALRKEAAAIRDELQAYRHN | PD1 | |
| 1019 | MGSWVMFKWLLADIKSHLEALGGSEAELAFFEGFIAAFETHLQVYKGKGNPEVEALRKEAAAIRDELQAYRHN | PD1 | |
| 1020 | MGSWYAFKDYLADIKGWLEALGGSEAELAFFEIFIARFELELQAYKGKGNPEVEALRKEAAAIRDELQAYRHN | PD1 | |
| 1021 | MGSWAEFKQRLAAIKTRLEALGGSEAELAAFEKEIAAFESELQAYKGKGNPEVEALRKEAAAIRDELQAYRHN | None known | |
| 1030 | MGSWEEFELRLNAIEERLYALGGSEAELAYFEYVIADFEGNLQRYKGKGNPEVEALYFEADAIFEELVAYRHN | CD19 | |
| 1031 | MGSWFEFNHRLWAIFERLMALGGSEAELAAFEKEIAAFESELQAYKGKGNPEVEYLRAMAAVIRYHLQAYRHN | CD19 | |
| 1032 | MGSWEEFDGRLFAIEQRLQALGGSEAELAAFEKEIAAFESELQAYKGKGNPEVEVLRWFAAGIRDFLQAYRHN | CD19 | |
| 1033 | MGSWAEFYHRLYAIETRLSALGGSEAELAAFEKEIAAFESELQAYKGKGNPEVEYLRHWAAWIRTYLQAYRHN | CD19 | |
| 1034 | MGSWVEFSDRLYAIEERLWALGGSEAELAAFEKEIAAFESELQAYKGKGNPEVEELRELAAIIRHSLQAYRHN | CD19 | |
| 1035 | MGSWWEFEGRLYAIEERLTALGGSEAELAAFEKEIAAFESELQAYKGKGNPEVEYLREWAAWIRQMLQAYRHN | CD19 | |
| 1036 | MGSWWEFEHRLYAIEERLVALGGSEAELAAFEKEIAAFESELQAYKGKGNPEVEYLRNWAAYIRMALQAYRHN | CD19 | |
| 1037 | MGSWWEFEARLYAIEFRLSALGGSEAELAAFEKEIAAFESELQAYKGKGNPEVEYLRSWAAYIRTSLQAYRHN | CD19 | |
| 1038 | MGSWWEFEARLWAIESRLKALGGSEAELAAFEKEIAAFESELQAYKGKGNPEVEYLRHWAAYIRVILQAYRHN | CD19 | |
| 1039 | MGSWWEFEARLYAIEFRLSALGGSEAELAAFEKEIAAFESELQAYKGKGNPEVEYLRSWAAYIRTSLQAYRHN | CD19 | |
| 1040 | MGSWEEFYHRLDAIELRLYALGGSEAELAAFEKEIAAFESELQAYKGKGNPEVEYLRWYAAEIREILQAYRHN | CD19 | |
| 1041 | MGSWYEFYERLDAIDTRLWALGGSEAELAAFEKEIAAFESELQAYKGKGNPEVEFLREYAAEIRHFLQAYRHN | CD19 | |

TABLE 3-continued

Exemplary D-domains

| SEQ ID NO: | D-Domain Sequence | Target | ELISA_avg |
|---|---|---|---|
| 1042 | MGSWNEFFDRLDAILYRLDALGGSEAELAAFEKEIAAFESELQAYKGKGNPEVEYLRFVAADIRSWLQAYRHN | CD19 | |
| 1043 | MGSWIEFDDRLLAIMDRLWALGGSEAELAAFEKEIAAFESELQAYKGKGNPEVEDLRDVAADIRHYLQAYRHN | CD19 | |
| 1044 | MGSWYEFWERLDAITFRLYALGGSEAELAAFEKEIAAFESELQAYKGKGNPEVEDLRTWAADIRAILQAYRHN | CD19 | |
| 1045 | MGSWEEFYIRLDAIMERLWALGGSEAELAAFEKEIAAFESELQAYKGKGNPEVEDLRYAAADIRHFLQAYRHN | CD19 | |
| 1046 | MGSWIEFEERLYAIETRLLALGGSEAELAAFEKEIAAFESELQAYKGKGNPEVEFLRVVAADIREWLQAYRHN | CD19 | |
| 1047 | MGSWIEFEHRLSAINDRLYALGGSEAELAAFEKEIAAFESELQAYKGKGNPEVEDLREWAADIRSLLQAYRHN | CD19 | |
| 1048 | MGSWFEFEMRLDAIMARLWALGGSEAELAAFEKEIAAFESELQAYKGKGNPEVEDLRYAAADIRDYLQAYRHN | CD19 | |
| 1049 | MGSWYEFVYRLDAIYDRLWALGGSEAELAAFEKEIAAFESELQAYKGKGNPEVEDLRYAAADIRDFLQAYRHN | CD19 | |

TABLE 3-continued

Exemplary D-domains

| SEQ ID NO: | D-Domain Sequence | Target | ELISA_avg |
|---|---|---|---|
| 1067 | MGSWNEFYNRLHAIHQRLYALGGSEAELAAFEKEIAAFESELQAYKGKGNPEVESLRQTAAYIRDRLQAYRHN | CD22 | |
| 1068 | MGSWNEFADRLHAIHQRLYALGGSEAELAAFEKEIAAFESELQAYKGKGNPEVESLRMTAAFIRSRLQAYRHN | CD22 | |
| 1069 | MGSWTEFSYRLGAIQSRLHALGGSEAELAAFEKEIAAFESELQAYKGKGNPEVEHLRYNAAKIRHFLQAYRHN | CD22 | |
| 1070 | MGSWQEFTTRLEAIYHRLRALGGSEAELANFEGFIAEFEGNLQMYKGKGNPEVEALVHEAYAIMEELHAYRHN | DR5 | |
| 1071 | MGSWVEFFDRLKAIHDRLEALGGSEAELAHFEKLIAHFEHRLQNYKGKGNPEVEALEKEADAILYELAAYRHN | DR5 | |
| 1072 | MGSWYYFKHHLAWIKMELEALGGSEAELAHFESSIASFERDLQQYKGKGNPEVEALRKEAAAIRDELQAYRHN | DR5 | |
| 1073 | MGSWVEFHIRLHAIQYRLYALGGSEAELAAFEKEIAAFESELQAYKGKGNPEVEELRHWAAFIRLQLQAYRHN | DR5 | |
| 1074 | MGSWNEFHDRLNAIHARLHALGGSEAELAAFEKEIAAFESELQAYKGKGNPEVENLRDDAAFIRRFLQAYRHN | PDL1 | |
| 1075 | MGSWYEFTVRLEAIHERLKALGGSEAELAAFEKEIAAFESELQAYKGKGNPEVEILRDDAAFIRRFLQAYRHN | PDL1 | |
| 1076 | MGSWKEFDDRLNAIKARLQALGGSEAELAAFEKEIAAFESELQAYKGKGNPEVEDLRDDAAFIRRFLQAYRHN | PDL1 | |
| 1077 | MGSWYEFDDRLNAIHDRLQALGGSEAELAAFEKEIAAFESELQAYKGKGNPEVEDLRDDAAFIRRFLQAYRHN | PDL1 | |
| 1078 | MGSWNEFKNRLDAIHKRLNALGGSEAELAAFEKEIAAFESELQAYKGKGNPEVENLRDDAAFIRHFLQAYRHN | PDL1 | |
| 1079 | MGSWTEFEQRLEAIHNRLQALGGSEAELAAFEKEIAAFESELQAYKGKGNPEVEELRNDAAFIRHFLQAYRHN | PDL1 | |
| 780 | MGSWVEFEARLSAIYERLEALGGSEAELAAFEKEIAAFESELQAYKGKGNPEVEKLRRHAAGIRSNLQAYRHN | CS1 | |
| 781 | MGSWVEFFVRLDAIWERLEALGGSEAELAAFEKEIAAFESELQAYKGKGNPEVETLRFHAAGIRQKLQAYRHN | CS1 | |
| 782 | MGSWTEFNLRLDAIYERLEALGGSEAELAAFEKEIAAFESELQAYKGKGNPEVEALRWHAAGIRQQLQAYRHN | CS1 | |
| 783 | MGSWMEFYDRLDAIWVRLEALGGSEAELAAFEKEIAAFESELQAYKGKGNPEVEVLRFHAAGIREQLQAYRHN | CS1 | |
| 784 | MGSWHEFNGRLWAIYARLDALGGSEAELAAFEKEIAAFESELQAYKGKGNPEVETLRRHAAGIRGILQAYRHN | CS1 | |
| 785 | MGSWYEFVQRLHAINDRLSALGGSEAELAAFEKEIAAFESELQAYKGKGNPEVEVLRRHAAGIRYTLQAYRHN | CS1 | |
| 786 | MGSWAEFYQRLNAIWNRLEALGGSEAELAAFEKEIAAFESELQAYKGKGNPEVEVLRRHAAGIRGQLQAYRHN | CS1 | |
| 787 | MGSWVEFNERLHAIYLRLDALGGSEAELAAFEKEIAAFESELQAYKGKGNPEVETLRRHAAGIRWQLQAYRHN | CS1 | |
| 788 | MGSWNEFKLELAFIKDWLEALGGSEAELANFEEAIAEFEAGLQGYKGKGNPEVEALRKEAAAIRDELQAYRHN | CS1 | |
| 789 | MGSWMEFEARLEAIWDRLEALGGSEAELAAFEKEIAAFESELQAYKGKGNPEVESLRFHAAGIRQHLQAYRHN | CS1 | |
| 790 | MGSWVEFEDRLNAIWWRLEALGGSEAELAAFEKEIAAFESELQAYKGKGNPEVEKLRRHAAGIRTQLQAYRHN | CS1 | |
| 791 | MGSWHHFKMHLAGIKLQLEALGGSEAELAEFEEWIADFEGALQDYKGKGNPEVEALRKEAAAIRDELQAYRHN | CS1 | |

TABLE 3-continued

Exemplary D-domains

| SEQ ID NO: | D-Domain Sequence | Target | ELISA_avg |
|---|---|---|---|
| 792 | MGSWAEFFARLDAIWERLEALGGSEAELAAFEKEIAAFESELQAYKGKGNPEVETLRFHAAGIRQKLQAYRHN | CS1 | |
| 793 | MGSWAEFFARLDAIWDRLEALGGSEAELAAFEKEIAAFESELQAYKGKGNPEVETLRFHAAGIRQKLQAYRHN | CS1 | |
| 794 | MGSWAEFFARLDAIWERLEALGGSEAELAAFEKEIAAFESELQAYKGKGNPEVETLKFHAAGIRQKLQAYRHN | CS1 | |
| 795 | MGSWAEFFARLDAIWDRLEALGGSEAELAAFEKEIAAFESELQAYKGKGNPEVETLKFHAAGIRQKLQAYRHN | CS1 | |
| 800 | MGSWHEFRWRLFAIWQRLHALGGSEAELAAFEKEIAAFESELQAYKGKGNPEVEWLRLDAALIRVMLQAYRHN | HER2 | 10.02 |
| 801 | MGSWAEFRWRLHAIWLKLGELGGSEAELAAFEKEIAAFESELQAYKGKGNPEVEWLREDAEQIKYILQAYRHN | HER2 | |
| 802 | MGSWAEFRWALHAIWLKLGELGGSEAELAAFEKEIAAFESELQAYKGKGNPEVEWLREDAEQIKYILQAYRHN | HER2 | |
| 803 | MGSWAEFRWRLHAIWLKLGALGGSEAELAAFEKEIAAFESELQAYKGKGNPEVEWLRQDAAQIKYILQAYRHN | HER2 | |
| 804 | MGSWAEFRWRLHAIWLQLGALGGSEAELAAFEKEIAAFESELQAYKGKGNPEVEWLRQDAAQIKYILQAYRHN | HER2 | |
| 805 | MGSWAEFRWRLHAIWLRLGALGGTEAELAAFEKEIAAFESELQAYKGKGNPEVEWLRQDAAQIKYILQAYRHN | HER2 | |
| 806 | MGSWAEFRWRLHAIWLRLGALGGSEAELAAFEKEIAAFESELQAYKGKGNPEVEWLRQDAAQIKYILQAYRHN | HER2 | |
| 807 | MGSWAEFRWKLEAIWLRLGALGGSEAELAAFEKEIAAFESELQAYKGKGNPEVEWLRQDAAQIKYILQAYRHN | HER2 | |
| 808 | MGSWAEFRWKLGAIWLRLGALGGSEAELAAFEKEIAAFESELQAYKGKGNPEVEWLRQDAAQIKYILQAYRHN | HER2 | |
| 809 | MGSWYEFRWRLHAIWLRLGALGGSEAELAAFEKEIAAFESELQAYKGKGNPEVEWLRQDAAQIRYILQAYRHN | HER2 | 7.18 |
| 810 | MGSWHEFLRRLLAIEMRLYALGGSEAELAAFEKEIAAFESELQAYKGKGNPEVEHLRVRAASIRQMLQAYRHN | HER2 | 8.15 |
| 811 | MGSWWGFKVNLAWIKWKLEALGGSEAELAYFELWIANFEHSLQEYKGKGNPEVEALRKEAAAIRDELQAYRHN | HER2 | 8.69 |
| 812 | MGSWVNFKTHLARIKVHLEALGGSEAELALFEHDIANFEQVLQQYKGKGNPEVEALRKEAAAIRDELQAYRHN | HER2 | 7.91 |
| 813 | MGSWLVFKDELAGIKNYLEALGGSEAELATFEQDIAWFEQWLQNYKGKGNPEVEALRKEAAAIRDELQAYRHN | HER2 | 3.28 |
| 814 | MGSWKTFKIELAGIKLELEALGGSEAELAGFENAIAQFESSLQYYKGKGNPEVEALRKEAAAIRDELQAYRHN | HER2 | 4.95 |
| 815 | MGSWWEFKVRLSAIQYRLYALGGSEAELAAFEKEIAAFESELQAYKGKGNPEVEALREQAALIRTILQAYRHN | HER2 | 5.17 |
| 816 | MGSWWEFHIRLHAINYRLAALGGSEAELAAFEKEIAAFESELQAYKGKGNPEVEALRELAAKIRGDLQAYRHN | HER2 | 11.90 |
| 817 | MGSWWEFQVRLRAIQYRLNALGGSEAELAAFEKEIAAFESELQAYKGKGNPEVEYLRGLAAQIRFDLQAYRHN | HER2 | 14.39 |
| 818 | MGSWWEFKIRLYAIEYRLNALGGSEAELAAFEKEIAAFESELQAYKGKGNPEVEALRAKAAQIRYNLQAYRHN | HER2 | 4.49 |
| 819 | MGSWFEFNIRLHAIEYRLKALGGSEAELAAFEKEIAAFESELQAYKGKGNPEVEELRNYAASIRKLLQAYRHN | HER2 | 7.86 |
| 820 | MGSWFEFEIRLRAIEYRLSALGGSEAELAAFEKEIAAFESELQAYKGKGNPEVEKLRELAAEIRYALQAYRHN | HER2 | 7.75 |

TABLE 3-continued

Exemplary D-domains

| SEQ ID NO: | D-Domain Sequence | Target | ELISA_avg |
|---|---|---|---|
| 821 | MGSWFEFKIRLYAIQYRLSALGGSEAELAAFEKEIAAFESELQAYKGKGNPEVEELRNLAAEIRHSLQAYRHN | HER2 | 13.08 |
| 822 | MGSWWEFKVRLRAIEYRLSALGGSEAELAAFEKEIAAFESELQAYKGKGNPEVEELRVLAASIRIHLQAYRHN | HER2 | 10.09 |
| 823 | MGSWSEFWFRLHAILYRLQALGGSEAELAAFEKEIAAFESELQAYKGKGNPEVETLRDAAAEIRVALQAYRHN | HER2 | 14.79 |
| 824 | MGSWIEFWVRLNAILYRLYALGGSEAELAAFEKEIAAFESELQAYKGKGNPEVEALRDSAAEIRRWLQAYRHN | HER2 | 3.91 |
| 825 | MGSWVEFWIRLNAIKYRLLALGGSEAELAAFEKEIAAFESELQAYKGKGNPEVEKLRQDAADIRELLQAYRHN | HER2 | 10.62 |
| 826 | MGSWTEFWWRLSAIVYRLNALGGSEAELAAFEKEIAAFESELQAYKGKGNPEVEELRDMAADIRSLLQAYRHN | HER2 | 5.76 |
| 827 | MGSWWEFYLRLRAISYRLQALGGSEAELAAFEKEIAAFESELQAYKGKGNPEVEGLRQDAAEIRKLLQAYRHN | HER2 | 5.10 |
| 828 | MGSWWEFHVRLRAIEYRLEALGGSEAELAAFEKEIAAFESELQAYKGKGNPEVEQLRLIAANIRHLLQAYRHN | HER2 | 5.48 |
| 829 | MGSWWEFHVRLKAIEYRLLALGGSEAELAAFEKEIAAFESELQAYKGKGNPEVEDLRYIAANIRQLLQAYRHN | HER2 | 4.56 |
| 830 | MGSWWEFKVRLKAIEYRLLALGGSEAELAAFEKEIAAFESELQAYKGKGNPEVEDLRYIAANIRQLLQAYRHN | HER2 | |
| 831 | MGSWWEFQVRLAAIEYRLKALGGSEAELAAFEKEIAAFESELQAYKGKGNPEVENLRQLAAHIRSVLQAYRHN | HER2 | 6.33 |
| 832 | MGSWWEFQVRLSAIEYRLTALGGSEAELAAFEKEIAAFESELQAYKGKGNPEVEELRQKAARIRSLLQAYRHN | HER2 | 9.61 |
| 833 | MGSWWEFNIRLHAIDYRLKALGGSEAELAAFEKEIAAFESELQAYKGKGNPEVELLREKAAQIRAQLQAYRHN | HER2 | 9.75 |
| 834 | MGSWWEFRVRLEAIDYRLKALGGSEAELAAFEKEIAAFESELQAYKGKGNPEVEYLRMKAATIRAILQAYRHN | HER2 | 6.82 |
| 835 | MGSWYEFDIRLEAIKYRLSALGGSEAELAAFEKEIAAFESELQAYKGKGNPEVEYLRKKAAVIRSMLQAYRHN | HER2 | 5.35 |
| 836 | MGSWWEFRIRLEAIWYRLHALGGSEAELAAFEKEIAAFESELQAYKGKGNPEVEDLRIFAANIRSKLQAYRHN | HER2 | 8.04 |
| 837 | MGSWWEFNVRLQAIKYRLSALGGSEAELAAFEKEIAAFESELQAYKGKGNPEVEDLRKTAAHIRWQLQAYRHN | HER2 | 5.23 |
| 838 | MGSWWEFNVRLSAIRYRLLALGGSEAELAAFEKEIAAFESELQAYKGKGNPEVEDLRASAAQIRAMLQAYRHN | HER2 | 6.73 |
| 839 | MGSWWEFNMRLSAIKYRLYALGGSEAELAAFEKEIAAFESELQAYKGKGNPEVEILRRLAADIRERLQAYRHN | HER2 | 3.08 |
| 840 | MGSWWEFHIRLRAIKYRLYALGGSEAELAAFEKEIAAFESELQAYKGKGNPEVEDLRILAAEIRAQLQAYRHN | HER2 | 14.79 |

TABLE 4

Exemplary Antigenic Determinant Sequences

| SEQ ID | Antigen | Sequence |
|---|---|---|
| 2 | CD19 | MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVETGLLLPRATAQDAGKYYCHRGNLTMSFHLEITARPVLWHWLLRTGGWK |

TABLE 4-continued

Exemplary Antigenic Determinant Sequences

| SEQ ID | Antigen | Sequence |
|---|---|---|
| 3 | CD19-Signal | PEEPLVVKVEEGDNAVLQCLKGTSDGPTQQLTWSRESPLKPFLKLSLGLPGLGIHMRPLAIW LFIFNVSQQMGGFYLCQPGPPSEKAWQPGWTVNVEGSGELFRWNVSDLGGLGCGLKNRSSEG PSSPSGKLMSPKLYVWAKDRPEIWEGEPPCLPPRDSLNQSLSQDLTMAPGSTLWLSCGVPPD SVSRGPLSWTHVHPKGPKSLLSLELKDDRPARDMWVMETGLLLPRATAQDAGKYYCHRGNLT MSFHLEITARPVLWHWLLRTGGWK |
| 4 | BCMA | MLQMAGQCSQNEYFDSLLHACIPCQLRCSSNTPPLTCQRYCNASVTNSVKGTNAILWTCLGL SLIISLAVFVLMFLLRKINSEPLKDEFKNTGSGLLGMANIDLEKSRTGDEIILPRGLEYTVE ECTCEDCIKSKPKVDSDHCFPLPAMEEGATILVTTKTNDYCKSLPAALSATEIEKSISAR |
| 5 | BCMA_ECD | MLQMAGQCSQNEYFDSLLHACIPCQLRCSSNTPPLTCQRYCNASVTNSVKGTNA |
| 6 | CD20 | AGIYAPI |
| 7 | CD20 | FLKMESLNFIRAHTP |
| 8 | CD20 | EPANPSEK |
| 9 | CD20 | KISHFLKMESLNFIRAHTPYINIYNCEPANPSEKNSPSTQYCYSIQS |
| 10 | CD20 | PICVTV |
| 11 | CD123-Signal | TKEDPNPPITNLRMKAKAQQLTWDLNRNVTDIECVKDADYSMPAVNNSYCQFGAISLCEVTN YTVRVANPPFSTWILFPENSGKPWAGAENLTCWIHDVDFLSCSWAVGPGAPADVQYDLYLNV ANRRQQYECLHYKTDAQGTRIGCRFDDISRLSSGSQSSHILVRGRSAAFGIPCTDKFVVFSQ IEILTPPNMTAKCNKTHSFMHWKMRSHFNRKFRYELQIQKRMQPVITEQVRDRTSFQLLNPG TYTVQIRARERVYEFLSAWSTPQRFECDQEEGANTRAWR |
| 12 | CD37 | DKTSFVSFVGLAFVPLQIWSK |
| 13 | CD37 | RAQLERSLRDVVEKTIQKYGTNPEETAAEESWDYVQFQLRCCGWHYPQDWFQVLILRGNGSE AHRVPCSCYNLSATNDSTILDKVILPQLSRLGHLARSRHSADICAVPAESHIYREGCAQGLQ KWLHNN |
| 14 | AFP | MKWVESIFLIFLLNFTESRTLHRNEYGIASILDSYQCTAEISLADLATIFFAQFVQEATYKE VSKMVKDALTAIEKPTGDEQSSGCLENQLPAFLEELCHEKEILEKYGHSDCCSQSEEGRHNC FLAHKKPTPASIPLFQVPEPVTSCEAYEEDRETFMNKFIYEIARRHPFLYAPTILLWAARYD KIIPSCCKAENAVECFQTKAATVTKELRESSLLNQHACAVMKNFGTRTFQAITVTKLSQKFT KVNFTEIQKLVLDVAHVHEHCCRGDVLDCLQDGEKIMSYICSQQDTLSNKITECCKLTTLER GQCIIHAENDEKPEGLSPNLNRFLGDRDFNQFSSGEKNIFLASFVHEYSRRHPQLAVSVILR VAKGYQELLEKCFQTENPLECQDKGEEELQKYIQESQALAKRSCGLFQKLGEYYLQNAFLVA YTKKAPQLTSSELMAITRKMAATAATCCQLSEDKLLACGEGAADIIIGHLCIRHEMTPVNPG VGQCCTSSYANRRPCFSSLVVDETYVPPAFSDDKFIFHKDLCQAQGVALQTMKQEFLINLVK QKPQITEEQLEAVIADFSGLLEKCCQGQEQEVCFAEEGQKLISKTRAALGV |
| 15 | AFP-Signal | RTLHRNEYGIASILDSYQCTAEISLADLATIFFAQFVQEATYKEVSKMVKDALTAIEKPTGD EQSSGCLENQLPAFLEELCHEKEILEKYGHSDCCSQSEEGRHNCFLAHKKPTPASIPLFQVP EPVTSCEAYEEDRETFMNKFIYEIARRHPFLYAPTILLWAARYDKIIPSCCKAENAVECFQT KAATVTKELRESSLLNQHACAVMKNFGTRTFQAITVTKLSQKFTKVNFTEIQKLVLDVAHVH EHCCRGDVLDCLQDGEKIMSYICSQQDTLSNKITECCKLTTLERGQCIIHAENDEKPEGLSP NLNRFLGDRDFNQFSSGEKNIFLASFVHEYSRRHPQLAVSVILRVAKGYQELLEKCFQTENP LECQDKGEEELQKYIQESQALAKRSCGLFQKLGEYYLQNAFLVAYTKKAPQLTSSELMAITR KMAATAATCCQLSEDKLLACGEGAADIIIGHLCIRHEMTPVNPGVGQCCTSSYANRRPCFSS LVVDETYVPPAFSDDKFIFHKDLCQAQGVALQTMKQEFLINLVKQKPQITEEQLEAVIADFS GLLEKCCQGQEQEVCFAEEGQKLISKTRAALGV |
| 16 | P26 | LEKCFQTENPLECQDKGEEELQKYIQESQALAKRSCGLFQKLGEYYLQNAFLVAYTKKAPQL TSSELMAITRKMAATAATCCQLSEDKLLACGEGAADIIIGHLCIRHEMTPVNPGVGQCCTSS YANRRPCFSSLVVDETYVPPAFSDDKFIFHKDLCQAQGVALQTMKQEFLINLVKQKPQITEE QLEAVIADFSGLLEKCCQGQEQEVCFAEEGQKLISKTRAALGV |
| 1117 | P26Q217P | LEKCFQTENPLECQDKGEEELQKYIQESQALAKRSCGLFQKLGEYYLQNAFLVAYTKKAPQL TSSELMAITRKMAATAATCCQLSEDKLLACGEGAADIIIGHLCIRHEMTPVNPGVGQCCTSS YANRRPCFSSLVVDETYVPPAFSDDKFIFHKDLCQAQGVALQTMKQEFLINLVKQKPQITEE QLEAVIADFSGLLEKCCQGQEQEVCFAEEGPKLISKTRAALGV |
| 1118 | P26(Q26-V229) | QESQALAKRSCGLFQKLGEYYLQNAFLVAYTKKAPQLTSSELMAITRKMAATAATCCQLSED KLLACGEGAADIIIGHLCIRHEMTPVNPGVGQCCTSSYANRRPCFSSLVVDETYVPPAFSDD KFIFHKDLCQAQGVALQTMKQEFLINLVKQKPQITEEQLEAVIADFSGLLEKCCQGQEQEVC FAEEGQKLISKTRAALGV |
| 1119 | P26(Q26-V229)Q217P | QESQALAKRSCGLFQKLGEYYLQNAFLVAYTKKAPQLTSSELMAITRKMAATAATCCQLSED KLLACGEGAADIIIGHLCIRHEMTPVNPGVGQCCTSSYANRRPCFSSLVVDETYVPPAFSDD KFIFHKDLCQAQGVALQTMKQEFLINLVKQKPQITEEQLEAVIADFSGLLEKCCQGQEQEVC FAEEGPKLISKTRAALGV |

TABLE 4-continued

Exemplary Antigenic Determinant Sequences

| SEQ ID | Antigen | Sequence |
|---|---|---|
| 1120 | p26(K23-V229) | KYIQESQALAKRSCGLFQKLGEYYLQNAFLVAYTKKAPQLTSSELMAITRKMAATAATCCQL<br>SEDKLLACGEGAADIIIGHLCIRHEMTPVNPGVGQCCTSSYANRRPCFSSLVVDETYVPPAF<br>SDDKFIFHKDLCQAQGVALQTMKQEFLINLVKQKPQITEEQLEAVIADFSGLLEKCCQGQEQ<br>EVCFAEEGQKLISKTRAALGV |
| 1121 | p26(K23-V229) Q217P | KYIQESQALAKRSCGLFQKLGEYYLQNAFLVAYTKKAPQLTSSELMAITRKMAATAATCCQL<br>SEDKLLACGEGAADIIIGHLCIRHEMTPVNPGVGQCCTSSYANRRPCFSSLVVDETYVPPAF<br>SDDKFIFHKDLCQAQGVALQTMKQEFLINLVKQKPQITEEQLEAVIADFSGLLEKCCQGQEQ<br>EVCFAEEGPKLISKTRAALGV |
| 1122 | p26(G17-V229) | GEEELQKYIQESQALAKRSCGLFQKLGEYYLQNAFLVAYTKKAPQLTSSELMAITRKMAATA<br>ATCCQLSEDKLLACGEGAADIIIGHLCIRHEMTPVNPGVGQCCTSSYANRRPCFSSLVVDET<br>YVPPAFSDDKFIFHKDLCQAQGVALQTMKQEFLINLVKQKPQITEEQLEAVIADFSGLLEKC<br>CQGQEQEVCFAEEGQKLISKTRAALGV |
| 1123 | p26(G17-V229) Q217P | GEEELQKYIQESQALAKRSCGLFQKLGEYYLQNAFLVAYTKKAPQLTSSELMAITRKMAATA<br>ATCCQLSEDKLLACGEGAADIIIGHLCIRHEMTPVNPGVGQCCTSSYANRRPCFSSLVVDET<br>YVPPAFSDDKFIFHKDLCQAQGVALQTMKQEFLINLVKQKPQITEEQLEAVIADFSGLLEKC<br>CQGQEQEVCFAEEGPKLISKTRAALGV |
| 41 | CD22 mature ECD | DSSKWVFEHPETLYAWEGACVWIPCTYRALDGDLESFILFHNPEYNKNTSKFDGTRLYESTKDGKVPSE<br>QKRVQFLGDKNKNCTLSIHPVHLNDSGQLGLRMESKTEKWMERIHLNVSERPFPPHIQLPPEIQESQEV<br>TLTCLLNFSCYGYPIQLQWLLEGVPMRQAAVTSTSLTIKSVFTRSELKFSPQWSHHGKIVTCQLQDADG<br>KFLSNDTVQLNVKHTPKLEIKVTPSDAIVREGDSVTMTCEVSSSNPEYTTVSWLKDGTSLKKQNTFTLN<br>LREVTKDQSGKYCCQVSNDVGPGRSEEVFLQVQYAPEPSTVQILHSPAVEGSQVEFLCMSLANPLPTNY<br>TWYHNGKEMQGRTEEKVHIPKILPWHAGTYSCVAENILGTGQRGPGAELDVQYPPKKVTTVIQNPMPIR<br>EGDTVTLSCNYNSSNPSVTRYEWKPHGAWEEPSLGVLKIQNVGWDNTTIACAACNSWCSWASPVALNVQ<br>YAPRDVRVRKIKPLSEIHSGNSVSLQCDFSSSHPKEVQFFWEKNGRLLGKESQLNFDSISPEDAGSYSC<br>WVNNSIGQTASKAWTLEVLYAPRRLRVSMSPGDQVMEGKSATLTCESDANPPVSHYTWFDWNNQSLPYH<br>SQKLRLEPVKVQHSGAYWCQGTNSVGKGRSPLSTLTVYYSPETIGRR |
| 1081 | CD137 mature ECD | LQDPCSNCPAGTFCDNNRNQICSPCPPNSFSSAGGQRTCDICRQCKGVFRTRKECSSTSNAECDCTPGF<br>HCLGAGCSMCEQDCKQGQELTKKGCKDCCFGTFNDQKRGICRPWTNCSLDGKSVLVNGTKERDVVCGPS<br>PADLSPGASSVTPPAPAREPGHSPQ |
| 1102 | Human CD45RABC | MTMYLWLKLLAFGFAFLDTEVFVTGQSPTPSPTGLTTAKMPSVPLSSDPLPTHTTAFSPASTFERENDF<br>SETTTSLSPDNTSTQVSPDSLDNASAFNTTGVSSVQTPHLPTHADSQTPSAGTDTQTFSGSAANAKLNP<br>TPGSNAISDVPGERSTASTFPTDPVSPLTTTLSLAHHSSAALPARTSNTTITANTSDAYLNASETTTLS<br>PSGSAVISTTTIATTPSKPTCDEKYANITVDYLYNKETKLFTAKLNVNENVECGNNTCTNNEVHNLTEC<br>KNASVSISHNSCTAPDKTLILDVPPGVEKFQLHDCTQVEKADTTICLKWKNIETFTCDTQNITYRFQCG<br>NMIFDNKEIKLENLEPEHEYKCDSEILYNNHKFTNASKIIKTDFGSPGEPQIIFCRSEAAHQGVITWNP<br>PQRSFHNFTLCYIKETEKDCLNLDKNLIKYDLQNLKPYTKYVLSLHAYIIAKVQRNGSAAMCHFTTKSA<br>PPSQVWNMTVSMTSDNSMHVKCRPPPRDRNGPHERYHLEVEAGNTLVRNESHKNCDFRVKDLQYSTDYTF<br>KAYFHNGDYPGEPFILHHSTSYNSKALIAFLAFLIIVTSIALLVVLYKIYDLHKKRSCNLDEQQELVER<br>DDEKQLMNVEPIHADILLETYKRKIADEGRLFLAEFQSIPRVFSKFPIKEARKPFNQNKNRYVDILPYD<br>YNRVELSEINGDAGSNYINASYIDGFKEPRKYIAAQGPRDETVDDFWRMIWEQKATVIVMVTRCEEGNR<br>NKCAEYWPSMEEGTRAFGDVVVKINQHKRCPDYIIQKLNIVNKKEKATGREVTHIQFTSWPDHGVPEDP<br>HLLLKLRRRVNAFSNFFSGPIVVHCSAGVGRTGTYIGIDAMLEGLEAENKVDVYGYVVKLRRQRCLMVQ<br>VEAQYILIHQALVEYNQFGETEVNLSELHPYLHNMKKRDPPSEPSPLEAEFQRLPSYRSWRTQHIGNQE<br>ENKSKNRNSNVIPYDYNRVPLKHELEMSKESEHDSDESSDDDSDSEEPSKYINASFIMSYWKPEVMIAA<br>QGPLKETIGDFWQMIFQRKVKVIVMLTELKHGDQEICAQYWGEGKQTYGDIEVDLKDTDKSSTYTLRVF<br>ELRHSKRKDSRTVYQYQYTNWSVEQLPAEPKELISMIQVVKQKLPQKNSSEGNKHHKSTPLLIHCRDGS<br>QQTGIFCALLNLLESAETEEVVDIFQVVKALRKARPGMVSTFEQYQFLYDVIASTYPAQNGVKKNNHQ<br>EDKIEFDNEVDKVKQDANCVNPLGAPEKLPEAKEQAEGSEPTSGTEGPEHSVNGPASPALNQGS |
| 1103 | Human CD45RO | MTMYLWLKLLAFGFAFLDTEVFVTGQSPTPSPTDAYLNASETTTLSPSGSAVISTTTIATTPSKPTCDE<br>KYANITVDYLYNKETKLFTAKLNVNENVECGNNTCTNNEVHNLTECKNASVSISHNSCTAPDKTLILDV<br>PPGVEKFQLHDCTQVEKADTTICLKWKNIETFTCDTQNITYRFQCGNMIFDNKEIKLENLEPEHEYKCD<br>SEILYNNHKFTNASKIIKTDFGSPGEPQIIFCRSEAAHQGVITWNPPQRSFHNFTLCYIKETEKDCLNL<br>DKNLIKYDLQNLKPYTKYVLSLHAYIIAKVQRNGSAAMCHFTTKSAPPSQVWNMTVSMTSDNSMHVKCR<br>PPRDRNGPHERYHLEVEAGNTLVRNESHKNCDFRVKDLQYSTDYTFKAYFHNGDYPGEPFILHHSTSYN<br>SKALIAFLAFLIIVTSIALLVVLYKIYDLHKKRSCNLDEQQELVERDDEKQLMNVEPIHADILLETYKR<br>KIADEGRLFLAEFQSIPRVFSKFPIKEARKPFNQNKNRYVDILPYDYNRVELSEINGDAGSNYINASYI<br>DGFKEPRKYIAAQGPRDETVDDFWRMIWEQKATVIVMVTRCEEGNRNKCAEYWPSMEEGTRAFGDVVVK<br>INQHKRCPDYIIQKLNIVNKKEKATGREVTHIQFTSWPDHGVPEDPHLLLKLRRRVNAFSNFFSGPIVV<br>HCSAGVGRTGTYIGIDAMLEGLEAENKVDVYGYVVKLRRQRCLMVQVEAQYILIHQALVEYNQFGETEV<br>NLSELHPYLHNMKKRDPPSEPSPLEAEFQRLPSYRSWRTQHIGNQEENKSKNRNSNVIPYDYNRVPLKH<br>ELEMSKESEHDSDESSDDDSDSEEPSKYINASFIMSYWKPEVMIAAQGPLKETIGDFWQMIFQRKVKVI<br>VMLTELKHGDQEICAQYWGEGKQTYGDIEVDLKDTDKSSTYTLRVFELRHSKRKDSRTVYQYQYTNWSV<br>EQLPAEPKELISMIQVVKQKLPQKNSSEGNKHHKSTPLLIHCRDGSQQTGIFCALLNLLESAETEEVVD<br>IFQVVKALRKARPGMVSTFEQYQFLYDVIASTYPAQNGQVKKNNHQEDKIEFDNEVDKVKQDANCVNPL<br>GAPEKLPEAKEQAEGSEPTSGTEGPEHSVNGPASPALNQGS |
| 1104 | Rhesus CD45RABC | MTMCLWLKLLAFVFAFLDTEVFVTGQSTLSPTGRRTTKMPSVPLSSDPLPTHTTAFSPASISERENDF<br>SETTPSLSSDNTSTHVSPDSLDNASAFNTTGVSSALTPHLPTHADSQTPSTGTDTQTPSGSAANTTLSP<br>TPRSNDISDVPGERSTASTFPTDPISPLATTLIPARNSSAALPARTSNTTITANTSVSYLNASETTTPS |

TABLE 4-continued

Exemplary Antigenic Determinant Sequences

| SEQ ID | Antigen | Sequence |
|---|---|---|
| | | PSGSTVISTPTIATTTSKPTCAEKYATIPVDYLYNNKTKLFTAKLNVNENVECTNNNHTHNICTNNEVL<br>NLPECKEMNVFVSHNSCTDRHKELKLDVPPEVEKFQLDDCTPDVEANTTICLKWKIIETFACDKSKITY<br>RFQCGNKTYNKEGIYLENLEPEYEYKCDSEILYNNHKYINITKLIKTDFGIPGQPQNVVCRHEDAHQGV<br>ITWNPPQRSFHNFTLCYVSKTAKKCLSLDKHLTTYHLQNLKPYTNYSLSLHAYIIAKVQRNGTAATCNF<br>TTESAPPSQVQNMIVSTSDNSMRVKCEGPRDVNGPTGLYHLEVEAGNTLVRNLSQSKCDFSVNNLQYST<br>YYNLKAYYHNGKYSGEPVILRESTSYNSKALIAFLAFLIIVTSIALLVVLYKIYDLHKKRSCNLDEQQE<br>LVERDDEKQLMNVEPIHADILLETYKRKIADEGRLFLAEFQSIPRVFSKFPIKEARKPFNQNKNRYVDI<br>LPYDYNRVELSEINGDAGSNYINASYIDGFKEPRKYIAAQGPRDETVDDFWRMIWEQKATVIVMTRCE<br>EGNRNKCAEYWPSMEEGTRAFGDVVVKINQHKRCPDYIIQKLNIVNKKEKATGREVTHIQFTSWPDHGV<br>PEDPHLLLKLRRRVNAFSNFFSGPIVVHCSAGVGRTGTYIGIDAMLEGLEAENKVDVYGYVVKLRRQRC<br>LMVQVEAQYILIHQALVEYNQFGETEVNLSELHPYLHNMKKRDPPSEPSPLEAEFQRLPSYRSWRTQHI<br>GNQEEENKNKNRSNVIPYDYNRVPLKHELEMSKESDHDSDESSDDDSDSEEPSKYINASFIMSYWKPEV<br>MIAAQGPLKETIGDFWQMIFQRKVKVIVMLTELKHGDQEICAQYWGEGKQTYGDIEVDMKDTNKSSTYT<br>LRVFELRHSKRKDSRTVYQYQYTNWSVEQLPAEPKELVSLIQVLKEKLPQKNSSEGNKHHKSTPLLIHC<br>RDGSQQTGIFCALLNLLESAETEEVVDIFQVVKALRKARPGMVSTFEQYQFLYDIIASTYPAQNGQVKK<br>NNHQEDKIEFDNEVDKVKQDANCVNPLGATEKLPEAKEQATGSEPTSGTEGPEHSVNGPASPALNQGS |
| 1105 | cynomolgus<br>CD45RABC | MTMCLWLKLLAFVFAFLDTEVFVTGQGSTLSPTGRRTTKMPSVPLSSDPLPTHTTAFSPASISERENDF<br>SETTPSLSSDNTSTQVSPDSLDNASAFNTTGVSSALTPHLPTHADSQTPSTGTDTQTPSGSAANTTLSP<br>TPRSNDISDVPGERSTASTFPTDPISPLATTLIPARNSSAALPARTSNTTITANTSVSYLNASETTTPS<br>PSGSTVISTPTIATTTSKPTCAEKYATIPVDYLYNNKTKLFTAKLNVNENVECTNNNHTHNICTNNEVL<br>NLPECKEMNVFVSHNSCTDRHKELKLDVPPEVEKFQLDDCTPDVEANTTICLKWKIIETFACDKSKITY<br>RFQCGNKTYNKEGIYLENLEPEYEYKCDSEILYNNHKYINITKLIKTDFGIPGQPQNVVCRHEDAHQGV<br>ITWNPPQRSFHNFTLCYVNKPAKKCLILDKHLTTYHLQNLKPYTNYSLSLHAYIIAKVQRNGTAATCNF<br>TTESAPPSQVQNMIVSTSDNSMHVKCEVPRDVNGPTGLYHLEVEAGNTLVRNLSQSKCDFSVNNLQYST<br>YYNLKAYYHNGKYSGEPVILRESTSYNSKALIAFLAFLIIVTSIALLVVLYKIYDLHKKRSCNLDEQQE<br>LVERDDEKQLMNVEPIHADILLETYKRKIADEGRLFLAEFQSIPRVFSKFPIKEARKPFNQNKNRYVDI<br>LPYDYNRVELSEINGDAGSNYINASYIDGFKEPRKYIAAQGPRDETVDDFWRMIWEQKATVIVMTRCE<br>EGNRNKCAEYWPSMEEGTRAFGDIVVKINQHKRCPDYIIQKLNIVNKKEKATGREVTHIQFTSWPDHGV<br>PEDPHLLLKLRRRVNAFSNFFSGPIVVHCSAGVGRTGTYIGIDAMLEGLEAENKVDVYGYVVKLRRQRC<br>LMVQVEAQYILIHQALVEYNQFGETEVNLSELHPYLHNMKKRDPPSEPSPLEAEFQRLPSYRSWRTQHI<br>GNQEEENKNKNRSNVIPYDYNRVPLKHELEMSKESDHDSDESSDDDSDSEEPSKYINASFIMSYWKPEV<br>MIAAQGPLKETIGDFWQMIFQRKVKVIVMLTELKHGDQEICAQYWGEGKQTYGDIEVDMKDTNKSSTYT<br>LRVFELRHSKRKDSRTVYQYQYTNWSVEQLPAEPKELVSLIQVLKEKLPQKNFSEGNKHHKSTPLLIHC<br>RDGSQQTGIFCALLNLLESAETEEVVDIFQVVKALRKARPGMVSTFEQYQFLYDIIASTYPAQNGQVKK<br>NNHQEDKIEFDNEVDKVKQDANCVNPLGATEKLPEAKEQATGSEPTSGTEGPEHSVNGPASPALNQGS |
| 1106 | Human<br>CD45RABC<br>ECD | QSPTPSPTGLTTAKMPSVPLSSDPLPTHTTAFSPASTFERENDFSETTTSLSPDNTSTQVSPDSLDNAS<br>AFNTTGVSSVQTPHLPTHADSQTPSAGTDTQTFSGSAANAKLNPTPGSNAISDVPGERSTASTFPTDPV<br>SPLTTTLSLAHHSSAALPARTSNTTITANTSDAYLNASETTTLSPSGSAVISTTTIATTPSKPTCDEKY<br>ANITVDYLYNKETKLFTAKLNVNENVECGNNTCTNNEVHNLTECKNASVSISHNSCTAPDKTLILDVPP<br>GVEKFQLHDCTQVEKADTTICLKWKNIETFTCDTQNITYRFQCGNMIFDNKEIKLENLEPEHEYKCDSE<br>ILYNNHKFTNASKIIKTDFGSPGEPQIIFCRSEAAHQGVITWNPPQRSFHNFTLCYIKETEKDCLNLDK<br>NLIKYDLQNLKPYTKYVLSLHAYIIAKVQRNGSAAMCHFTTKSAPPSQVWNMTVSMTSDNSMHVKCRPP<br>RDRNGPHERYHLEVEAGNTLVRNESHKNCDFRVKDLQYSTDYTFKAYFHNGDYPGEPFILHHSTSYNSK |
| 1107 | Human<br>CD45RO<br>ECD | QSPTPSPTDAYLNASETTTLSPSGSAVISTTTIATTPSKPTCDEKYANITVDYLYNKETKLFTAKLNVN<br>ENVECGNNTCTNNEVHNLTECKNASVSISHNSCTAPDKTLILDVPPGVEKFQLHDCTQVEKADTTICLK<br>WKNIETFTCDTQNITYRFQCGNMIFDNKEIKLENLEPEHEYKCDSEILYNNHKFTNASKIIKTDFGSPG<br>EPQIIFCRSEAAHQGVITWNPPQRSFHNFTLCYIKETEKDCLNLDKNLIKYDLQNLKPYTKYVLSLHAY<br>IIAKVQRNGSAAMCHFTTKSAPPSQVWNMTVSMTSDNSMHVKCRPPRDRNGPHERYHLEVEAGNTLVRN<br>ESHKNCDFRVKDLQYSTDYTFKAYFHNGDYPGEPFILHHSTSYNSK |
| 1108 | Human<br>CD45RA<br>ECD | QSPTPSPTGLTTAKMPSVPLSSDPLPTHTTAFSPASTFERENDFSETTTSLSPDNTSTQVSPDSLDNAS<br>AFNTTDAYLNASETTTLSPSGSAVISTTTIATTPSKPTCDEKYANITVDYLYNKETKLFTAKLNVNENV<br>ECGNNTCTNNEVHNLTECKNASVSISHNSCTAPDKTLILDVPPGVEKFQLHDCTQVEKADTTICLKWKN<br>IETFTCDTQNITYRFQCGNMIFDNKEIKLENLEPEHEYKCDSEILYNNHKFTNASKIIKTDFGSPGEPQ<br>IIFCRSEAAHQGVITWNPPQRSFHNFTLCYIKETEKDCLNLDKNLIKYDLQNLKPYTKYVLSLHAYIIA<br>KVQRNGSAAMCHFTTKSAPPSQVWNMTVSMTSDNSMHVKCRPPRDRNGPHERYHLEVEAGNTLVRNESH<br>KNCDFRVKDLQYSTDYTFKAYFHNGDYPGEPFILHHSTSYNSK |
| 1109 | Human<br>CD45RB | QSPTPSPTGVSSVQTPHLPTHADSQTPSAGTDTQTFSGSAANAKLNPTPGSNAISDAYLNASETTTLSP<br>SGSAVISTTTIATTPSKPTCDEKYANITVDYLYNKETKLFTAKLNVNENVECGNNTCTNNEVHNLTECK<br>NASVSISHNSCTAPDKTLILDVPPGVEKFQLHDCTQVEKADTTICLKWKNIETFTCDTQNITYRFQCGN<br>MIFDNKEIKLENLEPEHEYKCDSEILYNNHKFTNASKIIKTDFGSPGEPQIIFCRSEAAHQGVITWNPP<br>QRSFHNFTLCYIKETEKDCLNLDKNLIKYDLQNLKPYTKYVLSLHAYIIAKVQRNGSAAMCHFTTKSAP<br>PSQVWNMTVSMTSDNSMHVKCRPPRDRNGPHERYHLEVEAGNTLVRNESHKNCDFRVKDLQYSTDYTFK<br>AYFHNGDYPGEPFILHHSTSYNSK |
| 1110 | Human<br>CD45RAB<br>ECD | QSPTPSPTGLTTAKMPSVPLSSDPLPTHTTAFSPASTFERENDFSETTTSLSPDNTSTQVSPDSLDNAS<br>AFNTTGVSSVQTPHLPTHADSQTPSAGTDTQTFSGSAANAKLNPTPGSNAISDAYLNASETTTLSPSGS<br>AVISTTTIATTPSKPTCDEKYANITVDYLYNKETKLFTAKLNVNENVECGNNTCTNNEVHNLTECKNAS<br>VSISHNSCTAPDKTLILDVPPGVEKFQLHDCTQVEKADTTICLKWKNIETFTCDTQNITYRFQCGNMIF |

TABLE 4-continued

Exemplary Antigenic Determinant Sequences

| SEQ ID | Antigen | Sequence |
|---|---|---|
| | | DNKEIKLENLEPEHEYKCDSEILYNNHKFTNASKIIKTDFGSPGEPQIIFCRSEAAHQGVITWNPPQRS<br>FHNFTLCYIKETEKDCLNLDKNLIKYDLQNLKPYTKYVLSLHAYIIAKVQRNGSAAMCHFTTKSAPPSQ<br>VWNMTVSMTSDNSMHVKCRPPRDRNGPHERYHLEVEAGNTLVRNESHKNCDFRVKDLQYSTDYTFKAYF<br>HNGDYPGEPFILHHSTSYNSK |
| 1111 | Human<br>CD45RAC<br>ECD | QSPTPSPTGLTTAKMPSVPLSSDPLPTHTTAFSPASTFERENDFSETTTSLSPDNTSTQVSPDSLDNAS<br>AFNTTDVPGERSTASTFPTDPVSPLTTTLSLAHHSSAALPARTSNTTITANTSDAYLNASETTTLSPSG<br>SAVISTTTIATTPSKPTCDEKYANITVDYLYNKETKLFTAKLNVNENVECGNNTCTNNEVHNLTECKNA<br>SVSISHNSCTAPDKTLILDVPPGVEKFQLHDCTQVEKADTTICLKWKNIETFTCDTQNITYRFQCGNMI<br>FDNKEIKLENLEPEHEYKCDSEILYNNHKFTNASKIIKTDFGSPGEPQIIFCRSEAAHQGVITWNPPQR<br>SFHNFTLCYIKETEKDCLNLDKNLIKYDLQNLKPYTKYVLSLHAYIIAKVQRNGSAAMCHFTTKSAPPS<br>QVWNMTVSMTSDNSMHVKCRPPRDRNGPHERYHLEVEAGNTLVRNESHKNCDFRVKDLQYSTDYTFKAY<br>FHNGDYPGEPFILHHSTSYNSK |
| 1112 | Human<br>CD45RBC<br>ECD | QSPTPSPTGVSSVQTPHLPTHADSQTPSAGTDTQTFSGSAANAKLNPTPGSNAISDVPGERSTASTFPT<br>DPVSPLTTTLSLAHHSSAALPARTSNTTITANTSDAYLNASETTTLSPSGSAVISTTTIATTPSKPTCD<br>EKYANITVDYLYNKETKLFTAKLNVNENVECGNNTCTNNEVHNLTECKNASVSISHNSCTAPDKTLILD<br>VPPGVEKFQLHDCTQVEKADTTICLKWKNIETFTCDTQNITYRFQCGNMIFDNKEIKLENLEPEHEYKC<br>DSEILYNNHKFTNASKIIKTDFGSPGEPQIIFCRSEAAHQGVITWNPPQRSFHNFTLCYIKETEKDCLN<br>LDKNLIKYDLQNLKPYTKYVLSLHAYIIAKVQRNGSAAMCHFTTKSAPPSQVWNMTVSMTSDNSMHVKC<br>RPPRDRNGPHERYHLEVEAGNTLVRNESHKNCDFRVKDLQYSTDYTFKAYFHNGDYPGEPFILHRSTSY<br>NSK |
| 1113 | Human<br>CD26 | MKTPWKVLLGLLGAAALVTIITVPVVLLNKGTDDATADSRKTYTLTDYLKNTYRLKLYSLRWISDHEYL<br>YKQENNILVFNAEYGNSSVFLENSTFDEFGHSINDYSISPDGQFILLEYNYVKQWRHSYTASYDIYDLN<br>KRQLITEERIPNNTQWVTWSPVGHKLAYVWNNDIYVKIEPNLPSYRITWTGKEDIIYNGITDWVYEEEV<br>FSAYSALWWSPNGTFLAYAQFNDTEVPLIEYSFYSDESLQYPKTVRVPYPKAGAVNPTVKFFVVNTDSL<br>SSVTNATSIQITAPASMLIGDHYLCDVTWATQERISLQWLRRIQNYSVMDICYDESSGRWNCLVARQH<br>IEMSTTGWVGRFRPSEPHFTLDGNSFYKIISNEEGYRHICYFQIDKKDCTFITKGTWEVIGIEALTSDY<br>LYYISNEYKGMPGGRNLYKIQLSDYTKVTCLSCELNPERCQYYSVSFSKEAKYYQLRCSGPGLPLYTLH<br>SSVNDKGLRVLEDNSALDKMLQNVQMPSKKLDFIILNETKFWYQMILPPHFDKSKKYPLLLDVYAGPCS<br>QKADTVFRLNWATYLASTENIIVASFDGRGSGYQGDKIMHAINRRLGTFEVEDQIEAARQFSKMGFVDN<br>KRIAIWGWSYGGYVTSMVLGSGSGVFKCGIAVAPVSRWEYYDSVYTERYMGLPTPEDNLDHYRNSTVMS<br>RAENFKQVEYLLIHGTADDNVHFQQSAQISKALVDVGVDFQAMWYTDEDHGIASSTAHQHIYTHMSHFI<br>KQCFSLP |
| 1114 | Human<br>CD30 | MRVLLAALGLLFLGALRAFPQDRPFEDTCHGNPSHYYDKAVRRCCYRCPMGLFPTQQCPQRPTDCRKQC<br>EPDYYLDEADRCTACVTCSRDDLVEKTPCAWNSSRVCECRPGMFCSTSAVNSCARCFFHSVCPAGMIVK<br>FPGTAQKNTVCEPASPGVSPACASPENCKEPSSGTIPQAKPTPVSPATSSASTMPVRGGTRLAQEAASK<br>LTRAPDSPSSVGRPSSDPGLSPTQPCPEGSGDCRKQCEPDYYLDEAGRCTACVSCSRDDLVEKTPCAWN<br>SSRTCECRPGMICATSATNSCARCVPYIPCAAETVTKPQDMAEKDTTFEAPPLGTQPDCNPTPENGEAP<br>ASTSPTQSLLVDSQASKTLPIPTSAPVALSSTGKPVLDAGPVLFWVILVLVVVVGSSAFLLCHRRACRK<br>RIRQKLHLCYPVQTSQPKLELVDSRPRRSSTQLRSGASVTEPVAEERGLMSQPLMETCHSVGAAYLESL<br>PLQDASPAGGPSSPRDLPEPRVSTEHTNNKIEKIYIMKADTVIVGTVKAELPEGRGLAGPAEPELEEEL<br>EADHTPHYPEQETEPPLGSCSDVMLSVEEEGKEDPLPTAASGK |
| 1115 | Human<br>CD33 | MPLLLLLPLLWAGALAMDPNFWLQVQESVTVQEGLCVLVPCTFFHPIPYYDKNSPVHGYWFREGAIISR<br>DSPVATNKLDQEVQEETQGRFRLLGDPSRNNCSLSIVDARRRDNGSYFFRMERGSTKYSYKSPQLSVHV<br>TDLTHRPKILIPGTLEPGHSKNLTCSVSWACEQGTPPIFSWLSAAPTSLGPRTTHSSVLIITPRPQDHG<br>TNLTCQVKFAGAGVTTERTIQLNVTYVPQNPTTGIFPGDSGKQETRAGVVHGAIGGAGVTALLALCLC<br>LIFFIVKTHRRKAARTAVGRNDTHPTTGSASPKHQKKSKLHGPTETSSCSGAAPTVEMDEELHYASLNF<br>HGMNPSKDTSTEYSEVRTQ |
| 1116 | Human<br>CD38 | MANCEFSPVSGDKPCCRLSRRAQLCLGVSILVLILVVVLAVVVPRWRQQWSGPGTTKRFPETVLARCVK<br>YTEIHPEMRHVDCQSVWDAFKGAFISKHPCNITEEDYQPLMKLGTQTVPCNKILLWSRIKDLAHQFTQV<br>QRDMFTLEDTLLGYLADDLTWCGEFNTSKINYQSCPDWRKDCSNNPVSVFWKTVSRRFAEAACDVVHVM<br>LNGSRSKIFDKNSTFGSVEVHNLQPEKVQTLEAWVIHGGREDSRDLCQDPTIKELESIISKRNIQFSCK<br>NIYRPDKFLQCVKNPEDSSCTSEI |
| 1138 | CS1<br>mature<br>ECD | SGPVKELVGSVGGAVTFPLKSKVKQVDSIVWTFNTTPLVTIQPEGGTIIVTQNRNRERVDFPDGGYSLK<br>LSKLKKNDSGIYYVGIYSSSLQQPSTQEYVLHVYEHLSKPKVTMGLQSNKNGTCVTNLTCCMEHGEEDV<br>IYTWKALGQAANESHNGSILPISWRWGESDMTFICVARNPVSRNFSSPILARKLCEGAADDPDSSM |
| 1139 | CS1 | MAGSPTCLTLIYILWQLTGSAASGPVKELVGSVGGAVTFPLKSKVKQVDSIVWTFNTTPLVTIQPEGGT<br>IIVTQNRNRERVDFPDGGYSLKLSKLKKNDSGIYYVGIYSSSLQQPSTQEYVLHVYEHLSKPKVTMGLQ<br>SNKNGTCVTNLTCCMEHGEEDVIYTWKALGQAANESHNGSILPISWRWGESDMTFICVARNPVSRNFSS<br>PILARKLCEGAADDPDSSMVLLCLLLVPLLLSLFVLGLFLWFLKREROEEYIEEKKRVDICRETPNICP<br>HSGENTEYDTIPHTNRTILKEDPANTVYSTVEIPKKMENPHSLLTMPDTPRLFAYENVI |
| 42 | HER2<br>mature<br>ECD | TQVCTGTDMKLRLPASPETHLDMLRHLYQGCQVVQGNLELTYLPTNASLSFLQDIQEVQGYVLIAHNQV<br>RQVPLQRLRIVRGTQLFEDNYALAVLDNGDPLNNTTPVTGASPGGLRELQLRSLTEILKGGVLIQRNPQ<br>LCYQDTILWKDIFHKNNQLALTLIDTNRSRACHPCSPMCKGSRCWGESSEDCQSLTRTVCAGGCARCKG<br>PLPTDCCHEQCAAGCTGPKHSDCLACLHFNHSGICELHCPALVTYNTDTFESMPNPEGRYTFGASCVTA<br>CPYNYLSTDVGSCTLVCPLHNQEVTAEDGTQRCEKCSKPCARVCYGLGMEHLREVRAVTSANIQEFAGC<br>KKIFGSLAFLPESFDGDPASNTAPLQPEQLQVFETLEEITGYLYISAWPDSLPDLSVFQNLQVIRGRIL<br>HNGAYSLTLQGLGISWLGLRSLRELGSGLALIHHNTHLCFVHTVPWDQLFRNPHQALLHTANRPEDECV |

TABLE 4-continued

Exemplary Antigenic Determinant Sequences

| SEQ ID | Antigen | Sequence |
|---|---|---|
| | | GEGLACHQLCARGHCWGPGPTQCVNCSQFLRGQECVEECRVLQGLPREYVNARHCLPCHPECQPQNGSV TCFGPEADQCVACARYKEPPFCVARCPSGVKPELSYMPIWKFPDEEGACQPCPINCTHSCVELDEKGCP AEQRASPLT |

TABLE: 5

Exemplary Adapters

| SEQ ID NO: | AdapterDesign | Adapter Sequence |
|---|---|---|
| 1082 | CD123(cg06) — BCMA — HIS-tag | DEMGSWDEFGRRLYAIEWRLYALGGSEAELAAFEKEIAAFESEL QAYKGKGNPEVEKLREIAAVIRSNLQAYRHNGGGGSGGGGSGGG GSGMLQMAGQCSQNEYFDSLLHACIPCQLRCSSNTPPLTCQRYC NASVTNSVKGTNAGGGGSGGGGSGGGGSHHHHHHHHHH |
| 1083 | none(α3D) — BCMA — HIS-tag | DEGGGGSMGSWAEFKQRLAAIKTRLQALGGSEAELAAFEKEIAA FESELQAYKGKGNPEVEALRKEAAAIRDELQAYRHNGGGGSGGG GSGGGGSGMLQMAGQCSQNEYFDSLLHACIPCQLRCSSNTPPLT CQRYCNASVTNSVKGTNAGGGGSGGGGSGGGGSHHHHHHHHHH |
| 1084 | HIS-tag — CD123(cg06) — p26 | DEHHHHHHHHHHKLENLYFQGGGGGSMGSWDEFGRRLYAIEWRL YALGGSEAELAAFEKEIAAFESELQAYKGKGNPEVEKLREIAAV IRSNLQAYRHNGGGGSGGGGSGGGGSLEKCFQTENPLECQDKGE EELQKYIQESQALAKRSCGLFQKLGEYYLQNAFLVAYTKKAPQL TSSELMAITRKMAATAATCCQLSEDKLLACGEGAADIIIGHLCI RHEMTPVNPGVGQCCTSSYANRRPCFSSLVVDETYVPPAFSDDK FIFHKDLCQAQGVALQTMKQEFLINLVKQKPQITEEQLEAVIAD FSGLLEKCCQGQEQEVCFAEEGQKLISKTRAALGV |
| 1085 | HIS-tag — BCMA(bc40) — p26 | DEHHHHHHHHHHKLENLYFQGGGGGSMGSWSEFWVRLGAIRERL DALGGSEAELAAFEKEIAAFESELQAYKGKGNPEVEKLRYTAAT IRRFLQAYRHNGGGGSGGGGSGGGGSLEKCFQTENPLECQDKGE EELQKYIQESQALAKRSCGLFQKLGEYYLQNAFLVAYTKKAPQL TSSELMAITRKMAATAATCCQLSEDKLLACGEGAADIIIGHLCI RHEMTPVNPGVGQCCTSSYANRRPCFSSLVVDETYVPPAFSDDK FIFHKDLCQAQGVALQTMKQEFLINLVKQKPQITEEQLEAVIAD FSGLLEKCCQGQEQEVCFAEEGQKLISKTRAALGV |
| 1086 | HIS-tag — none(α3D-Q19E) — p26 | DEHHHHHHHHHHKLENLYFQGGGGGSMGSWAEFKQRLAAIKTRL EALGGSEAELAAFEKEIAAFESELQAYKGKGNPEVEALRKEAAA IRDELQAYRHNGGGGSGGGGSGGGGSLEKCFQTENPLECQDKGE EELQKYIQESQALAKRSCGLFQKLGEYYLQNAFLVAYTKKAPQL TSSELMAITRKMAATAATCCQLSEDKLLACGEGAADIIIGHLCI RHEMTPVNPGVGQCCTSSYANRRPCFSSLVVDETYVPPAFSDDK FIFHKDLCQAQGVALQTMKQEFLINLVKQKPQITEEQLEAVIAD FSGLLEKCCQGQEQEVCFAEEGQKLISKTRAALGV |
| 1087 | CD123(cg06-210) — p26 — CD123(cg06-210) — HIS-tag | DEGGGGSMGSWDEFGRRLYAIEWQLYALGGTEAELAAFEKEIAA FESELQAYKGKGNPEVEKLREIAAVIRENLQAYRHNGGGGSGGG GSGGGGSGLEKCFQTENPLECQDKGEEELQKYIQESQALAKRSC GLFQKLGEYYLQNAFLVAYTKKAPQLTSSELMAITRKMAATAAT CCQLSEDKLLACGEGAADIIIGHLCIRHEMTPVNPGVGQCCTSS YANRRPCFSSLVVDETYVPPAFSDDKFIFHKDLCQAQGVALQTM KQEFLINLVKQKPQITEEQLEAVIADFSGLLEKCCQGQEQEVCF AEEGQKLISKTRAALGVGGGGSGGGGSGGGGSMGSWDEFGRRLY AIEWQLYALGGTEAELAAFEKEIAAFESELQAYKGKGNPEVEKL REIAAVIRENLQAYRHNGGGGSGGGGSGGGGSHHHHHHHHHH |
| 1088 | BCMA(bc40) — p26 — BCMA(bc40) — HIS-tag | DEGGGGSMGSWSEFWVRLGAIRERLDALGGSEAELAAFEKEIAA FESELQAYKGKGNPEVEKLRYTAATIRRFLQAYRHNGGGGSGGG GSGGGGSGLEKCFQTENPLECQDKGEEELQKYIQESQALAKRSC GLFQKLGEYYLQNAFLVAYTKKAPQLTSSELMAITRKMAATAAT CCQLSEDKLLACGEGAADIIIGHLCIRHEMTPVNPGVGQCCTSS YANRRPCFSSLVVDETYVPPAFSDDKFIFHKDLCQAQGVALQTM KQEFLINLVKQKPQITEEQLEAVIADFSGLLEKCCQGQEQEVCF AEEGQKLISKTRAALGVGGGGSGGGGSGGGGSMGSWSEFWVRLG AIRERLDALGGSEAELAAFEKEIAAFESELQAYKGKGNPEVEKL RYTAATIRRFLQAYRHNGGGGSGGGGSGGGGSHHHHHHHHHH |
| 1124 | BCMA(bc98) — p26 JPE — HIS-tag | DEGGGGSMGSWSEFWARLGAIRERLDALGGSEAELAAFEKEIAA FESELQAYKGKGNPEVEKLRYTAGTIKRFLQAYRHNGGGDGGG GSGGGGSGLEKCFQTENPLECQDKGEEELQKYIQESQALAKRSC GLFQKLGEYYLQNAFLVAYTKKAPQLTSSELMAITRKMAATAAT CCQLSEDKLLACGEGAADIIIGHLCIRHEMTPVNPGVGQCCTSS |

TABLE: 5 -continued

Exemplary Adapters

| SEQ ID NO: | AdapterDesign | Adapter Sequence |
|---|---|---|
|  |  | YANRRPCFSSLVVDETYVPPAFSDDKFIFHKDLCQAQGVALQTM<br>KQEFLINLVKQKPQITEEQLEAVIADFSGLLEKCCQGQEQEVCF<br>AEEGQKLISKTRAALGVGGGGSGGGGSGGGGSHHHHHHHHHH |
| 1125 | BCMA(bc98) — p26 — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGLEKCFQTENPLECQDKGEEELQKYIQESQALAKRSCGLFQK<br>LGEYYLQNAFLVAYTKKAPQLTSSELMAITRKMAATAATCCQLS<br>EDKLLACGEGAADIIIGHLCIRHEMTPVNPGVGQCCTSSYANRR<br>PCFSSLVVDETYVPPAFSDDKFIFHKDLCQAQGVALQTMKQEFL<br>INLVKQKPQITEEQLEAVIADFSGLLEKCCQGQEQEVCFAEEGQ<br>KLISKTRAALGVGGGGSGGGGSGGGGSHHHHHHHHHH |
| 1126 | BCMA(bc98) — p26(Q26-V229) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGQESQALAKRSCGLFQKLGEYYLQNAFLVAYTKKAPQLTSSE<br>LMAITRKMAATAATCCQLSEDKLLACGEGAADIIIGHLCIRHEM<br>TPVNPGVGQCCTSSYANRRPCFSSLVVDETYVPPAFSDDKFIFH<br>KDLCQAQGVALQTMKQEFLINLVKQKPQITEEQLEAVIADFSGL<br>LEKCCQGQEQEVCFAEEGQKLISKTRAALGVGGGGSGGGGSGGG<br>GSHHHHHHHHHH |
| 1127 | BCMA(bc98) — p26(K23-V229) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGKYIQESQALAKRSCGLFQKLGEYYLQNAFLVAYTKKAPQLT<br>SSELMAITRKMAATAATCCQLSEDKLLACGEGAADIIIGHLCIR<br>HEMTPVNPGVGQCCTSSYANRRPCFSSLVVDETYVPPAFSDDKF<br>IFHKDLCQAQGVALQTMKQEFLINLVKQKPQITEEQLEAVIADF<br>SGLLEKCCQGQEQEVCFAEEGQKLISKTRAALGVGGGGSGGGGS<br>GGGGSHHHHHHHHHH |
| 1128 | BCMA(bc98) — p26(G17-V229) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGGEEELQKYIQESQALAKRSCGLFQKLGEYYLQNAFLVAYTK<br>KAPQLTSSELMAITRKMAATAATCCQLSEDKLLACGEGAADIII<br>GHLCIRHEMTPVNPGVGQCCTSSYANRRPCFSSLVVDETYVPPA<br>FSDDKFIFHKDLCQAQGVALQTMKQEFLINLVKQKPQITEEQLE<br>AVIADFSGLLEKCCQGQEQEVCFAEEGQKLISKTRAALGVGGGG<br>SGGGGSGGGGSHHHHHHHHHH |
| 1129 | BCMA(bc98) — p26 — BCMA(bc98) — HIS-tag | DEGGGGSMGSWSEFWARLGAIRERLDALGGSEAELAAFEKEIAA<br>FESELQAYKGKGNPEVEKLRYTAGTIKRFLQAYRHNGGGGDGGG<br>GSGGGGSGLEKCFQTENPLECQDKGEEELQKYIQESQALAKRSC<br>GLFQKLGEYYLQNAFLVAYTKKAPQLTSSELMAITRKMAATAAT<br>CCQLSEDKLLACGEGAADIIIGHLCIRHEMTPVNPGVGQCCTSS<br>YANRRPCFSSLVVDETYVPPAFSDDKFIFHKDLCQAQGVALQTM<br>KQEFLINLVKQKPQITEEQLEAVIADFSGLLEKCCQGQEQEVCF<br>AEEGQKLISKTRAALGVGGGGSGGGGSGGGGSMGSWSEFWARLG<br>AIRERLDALGGSEAELAAFEKEIAAFESELQAYKGKGNPEVEKL<br>RYTAGTIKRFLQAYRHNGGGGDGGGGSGGGGSHHHHHHHHHH |
| 1130 | BCMA(bc98) — p26(Q26-V229; Q217P) — BCMA(bc98) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGQESQALAKRSCGLFQKLGEYYLQNAFLVAYTKKAPQLTSSE<br>LMAITRKMAATAATCCQLSEDKLLACGEGAADIIIGHLCIRHEM<br>TPVNPGVGQCCTSSYANRRPCFSSLVVDETYVPPAFSDDKFIFH<br>KDLCQAQGVALQTMKQEFLINLVKQKPQITEEQLEAVIADFSGL<br>LEKCCQGQEQEVCFAEEGPKLISKTRAALGVGGGGSGGGGSGGG<br>GSMGSWSEFWARLGAIRERLDALGGSEAELAAFEKEIAAFESEL<br>QAYKGKGNPEVEKLRYTAGTIKRFLQAYRHNGGGGSGGGGSGGG<br>GSHHHHHHHHHH |
| 1131 | BCMA(bc98) — p26(Q26-V229; Q217P) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGQESQALAKRSCGLFQKLGEYYLQNAFLVAYTKKAPQLTSSE<br>LMAITRKMAATAATCCQLSEDKLLACGEGAADIIIGHLCIRHEM<br>TPVNPGVGQCCTSSYANRRPCFSSLVVDETYVPPAFSDDKFIFH<br>KDLCQAQGVALQTMKQEFLINLVKQKPQITEEQLEAVIADFSGL<br>LEKCCQGQEQEVCFAEEGPKLISKTRAALGVGGGGSGGGGSGGG<br>GSHHHHHHHHHH |
| 1132 | BCMA(bc98) — p26(Q26-V229) — BCMA(bc98) — HIS-tag | DEMGSWSEFWARLGAIRERLDALGGSEAELAAFEKEIAAFESEL<br>QAYKGKGNPEVEKLRYTAGTIKRFLQAYRHNGGGGDGGGGSGGG<br>GSGQESQALAKRSCGLFQKLGEYYLQNAFLVAYTKKAPQLTSSE<br>LMAITRKMAATAATCCQLSEDKLLACGEGAADIIIGHLCIRHEM<br>TPVNPGVGQCCTSSYANRRPCFSSLVVDETYVPPAFSDDKFIFH |

TABLE: 5 -continued

Exemplary Adapters

| SEQ ID NO: | AdapterDesign | Adapter Sequence |
| --- | --- | --- |
| | | KDLCQAQGVALQTMKQEFLINLVKQKPQITEEQLEAVIADFSGL<br>LEKCCQGQEQEVCFAEEGQKLISKTRAALGVGGGGSGGGGSGGG<br>GSMGSWSEFWARLGAIRERLDALGGSEAELAAFEKEIAAFESEL<br>QAYKGKGNPEVEKLRYTAGTIKRFLQAYRHNGGGGSGGGGSGGG<br>GSHHHHHHHHHH |
| 1141 | 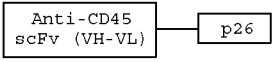 Anti-CD45 scFv (VH-VL) — p26 | QVQLVESGGGLVQPGGSLKLSCAASGFDFSRYWMSWVRQAPGKG<br>LEWIGEINPTSSTINFTPSLKDKVFISRDNAKNTLYLQMSKVRS<br>EDTALYYCARGNYYRYGDAMDYWGQGTSVTVSGGGGSGGGGSAG<br>GGSDIVLTQSPASLAVSLGQRATISCRASKSVSTSGYSYLHWYQ<br>QKPGQPPKLLIYLASNLESGVPARFSGSGSGTDFTLNIHPVEEE<br>DAATYYCQHSRELPFTFGSGTKLEIKGGGGSGGGGSGGGGSGLE<br>KCFQTENPLECQDKGEEELQKYIQESQALAKRSCGLFQKLGEYY<br>LQNAFLVAYTKKAPQLTSSELMAITRKMAATAATCCQLSEDKLL<br>ACGEGAADIIIGHLCIRHEMTPVNPGVGQCCTSSYANRRPCFSS<br>LVVDETYVPPAFSDDKFIFHKDLCQAQGVALQTMKQEFLINLVK<br>QKPQITEEQLEAVIADFSGLLEKCCQGQEQEVCFAEEGQKLISK<br>TRAALGV |
| 1142 | 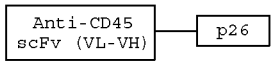 Anti-CD45 scFv (VL-VH) — p26 | DIVLTQSPASLAVSLGQRATISCRASKSVSTSGYSYLHWYQQKP<br>GQPPKLLIYLASNLESGVPARFSGSGSGTDFTLNIHPVEEEDAA<br>TYYCQHSRELPFTFGSGTKLEIKGGGGSGGGGSAGGGSQVQLVE<br>SGGGLVQPGGSLKLSCAASGFDFSRYWMSWVRQAPGKGLEWIGE<br>INPTSSTINFTPSLKDKVFISRDNAKNTLYLQMSKVRSEDTALY<br>YCARGNYYRYGDAMDYWGQGTSVTVSGGGGSGGGGSGGGGSGLE<br>KCFQTENPLECQDKGEEELQKYIQESQALAKRSCGLFQKLGEYY<br>LQNAFLVAYTKKAPQLTSSELMAITRKMAATAATCCQLSEDKLL<br>ACGEGAADIIIGHLCIRHEMTPVNPGVGQCCTSSYANRRPCFSS<br>LVVDETYVPPAFSDDKFIFHKDLCQAQGVALQTMKQEFLINLVK<br>QKPQITEEQLEAVIADFSGLLEKCCQGQEQEVCFAEEGQKLISK<br>TRAALGV |
| 1143 |  p26 — Anti-CD45 scFv (VH-VL) | LEKCFQTENPLECQDKGEEELQKYIQESQALAKRSCGLFQKLGE<br>YYLQNAFLVAYTKKAPQLTSSELMAITRKMAATAATCCQLSEDK<br>LLACGEGAADIIIGHLCIRHEMTPVNPGVGQCCTSSYANRRPCF<br>SSLVVDETYVPPAFSDDKFIFHKDLCQAQGVALQTMKQEFLINL<br>VKQKPQITEEQLEAVIADFSGLLEKCCQGQEQEVCFAEEGQKLI<br>SKTRAALGVGGGGSGGGGSGGGGSGGGGSGQVQLVESGGGLVQPGGSLK<br>LSCAASGFDFSRYWMSWVRQAPGKGLEWIGEINPTSSTINFTPS<br>LKDKVFISRDNAKNTLYLQMSKVRSEDTALYYCARGNYYRYGDA<br>MDYWGQGTSVTVSGGGGSGGGGSAGGGSDIVLTQSPASLAVSLG<br>QRATISCRASKSVSTSGYSYLHWYQQKPGQPPKLLIYLASNLES<br>GVPARFSGSGSGTDFTLNIHPVEEEDAATYYCQHSRELPFTFGS<br>GTKLEIK |
| 1144 |  p26 — Anti-CD45 scFv (VL-VH) | LEKCFQTENPLECQDKGEEELQKYIQESQALAKRSCGLFQKLGE<br>YYLQNAFLVAYTKKAPQLTSSELMAITRKMAATAATCCQLSEDK<br>LLACGEGAADIIIGHLCIRHEMTPVNPGVGQCCTSSYANRRPCF<br>SSLVVDETYVPPAFSDDKFIFHKDLCQAQGVALQTMKQEFLINL<br>VKQKPQITEEQLEAVIADFSGLLEKCCQGQEQEVCFAEEGQKLI<br>SKTRAALGVGGGGSGGGGSGGGGSGDIVLTQSPASLAVSLGQRA<br>TISCRASKSVSTSGYSYLHWYQQKPGQPPKLLIYLASNLESGVP<br>ARFSGSGSGTDFTLNIHPVEEEDAATYYCQHSRELPFTFGSGTK<br>LEIKGGGGSGGGGSAGGGSQVQLVESGGGLVQPGGSLKLSCAAS<br>GFDFSRYWMSWVRQAPGKGLEWIGEINPTSSTINFTPSLKDKVF<br>ISRDNAKNTLYLQMSKVRSEDTALYYCARGNYYRYGDAMDYWGQ<br>GTSVTVS |
| 1145 | 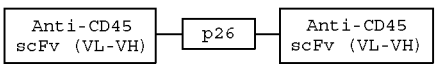 Anti-CD45 scFv (VL-VH) — p26 — Anti-CD45 scFv (VL-VH) | DIVLTQSPASLAVSLGQRATISCRASKSVSTSGYSYLHWYQQKP<br>GQPPKLLIYLASNLESGVPARFSGSGSGTDFTLNIHPVEEEDAA<br>TYYCQHSRELPFTFGSGTKLEIKGGGGSGGGGSAGGGSQVQLVE<br>SGGGLVQPGGSLKLSCAASGFDFSRYWMSWVRQAPGKGLEWIGE<br>INPTSSTINFTPSLKDKVFISRDNAKNTLYLQMSKVRSEDTALY<br>YCARGNYYRYGDAMDYWGQGTSVTVSGGGGSGGGGSGGGGSGLE<br>KCFQTENPLECQDKGEEELQKYIQESQALAKRSCGLFQKLGEYY<br>LQNAFLVAYTKKAPQLTSSELMAITRKMAATAATCCQLSEDKLL<br>ACGEGAADIIIGHLCIRHEMTPVNPGVGQCCTSSYANRRPCFSS<br>LVVDETYVPPAFSDDKFIFHKDLCQAQGVALQTMKQEFLINLVK<br>QKPQITEEQLEAVIADFSGLLEKCCQGQEQEVCFAEEGQKLISK<br>TRAALGVGGGGSGGGGSGGGGSGDIVLTQSPASLAVSLGQRATI<br>SCRASKSVSTSGYSYLHWYQQKPGQPPKLLIYLASNLESGVPAR<br>FSGSGSGTDFTLNIHPVEEEDAATYYCQHSRELPFTFGSGTKLE |

TABLE: 5 -continued

Exemplary Adapters

| SEQ ID NO: | AdapterDesign | Adapter Sequence |
|---|---|---|
| | | IKGGGGSGGGGSAGGGSQVQLVESGGGLVQPGGSLKLSCAASGF DFSRYWMSWVRQAPGKGLEWIGEINPTSSTINFTPSLKDKVFIS RDNAKNTLYLQMSKVRSEDTALYYCARGNYYRYGDAMDYWGQGT SVTVS |
| 1146 | Anti-CD45 scFv (VH-VL) — p26 — Anti-CD45 scFv (VH-VL) | QVQLVESGGGLVQPGGSLKLSCAASGFDFSRYWMSWVRQAPGKG LEWIGEINPTSSTINFTPSLKDKVFISRDNAKNTLYLQMSKVRS EDTALYYCARGNYYRYGDAMDYWGQGTSVTVSGGGGSGGGGSAG GGSDIVLTQSPASLAVSLGQRATISCRASKSVSTSGYSYLHWYQ QKPGQPPKLLIYLASNLESGVPARFSGSGSGTDFTLNIHPVEEE DAATYYCQHSRELPFTFGSGTKLEIKGGGGSGGGGSGGGGSGLE KCFQTENPLECQDKGEEELQKYIQESQALAKRSCGLFQKLGEYY LQNAFLVAYTKKAPQLTSSELMAITRKMAATAATCCQLSEDKLL ACGEGAADIIIGHLCIRHEMTPVNPGVGQCCTSSYANRRPCFSS LVVDETYVPPAFSDDKFIFHKDLCQAQGVALQTMKQEFLINLVK QKPQITEEQLEAVIADFSGLLEKCCQGQEQEVCFAEEGQKLISK TRAALGVGGGGSGGGGSGGGGSGQVQLVESGGGLVQPGGSLKLS CAASGFDFSRYWMSWVRQAPGKGLEWIGEINPTSSTINFTPSLK DKVFISRDNAKNTLYLQMSKVRSEDTALYYCARGNYYRYGDAMD YWGQGTSVTVSGGGGSGGGGSAGGGSDIVLTQSPASLAVSLGQR ATISCRASKSVSTSGYSYLHWYQQKPGQPPKLLIYLASNLESGV PARFSGSGSGTDFTLNIHPVEEEDAATYYCQHSRELPFTFGSGT KLEIK |
| 1147 | Anti-CD45 scFv (VL-VH) — p26 — Anti-CD45 scFv (VH-VL) | DIVLTQSPASLAVSLGQRATISCRASKSVSTSGYSYLHWYQQKP GQPPKLLIYLASNLESGVPARFSGSGSGTDFTLNIHPVEEEDAA TYYCQHSRELPFTFGSGTKLEIKGGGGSGGGGSAGGGSQVQLVE SGGGLVQPGGSLKLSCAASGFDFSRYWMSWVRQAPGKGLEWIGE INPTSSTINFTPSLKDKVFISRDNAKNTLYLQMSKVRSEDTALY YCARGNYYRYGDAMDYWGQGTSVTVSGGGGSGGGGSGGGGSGLE KCFQTENPLECQDKGEEELQKYIQESQALAKRSCGLFQKLGEYY LQNAFLVAYTKKAPQLTSSELMAITRKMAATAATCCQLSEDKLL ACGEGAADIIIGHLCIRHEMTPVNPGVGQCCTSSYANRRPCFSS LVVDETYVPPAFSDDKFIFHKDLCQAQGVALQTMKQEFLINLVK QKPQITEEQLEAVIADFSGLLEKCCQGQEQEVCFAEEGQKLISK TRAALGVGGGGSGGGGSGGGGSGQVQLVESGGGLVQPGGSLKLS CAASGFDFSRYWMSWVRQAPGKGLEWIGEINPTSSTINFTPSLK DKVFISRDNAKNTLYLQMSKVRSEDTALYYCARGNYYRYGDAMD YWGQGTSVTVSGGGGSGGGGSAGGGSDIVLTQSPASLAVSLGQR ATISCRASKSVSTSGYSYLHWYQQKPGQPPKLLIYLASNLESGV PARFSGSGSGTDFTLNIHPVEEEDAATYYCQHSRELPFTFGSGT KLEIK |
| 1148 | Anti-CD45 scFv (VH-VL) — p26 — Anti-CD45 scFv (VL-VH) | QVQLVESGGGLVQPGGSLKLSCAASGFDFSRYWMSWVRQAPGKG LEWIGEINPTSSTINFTPSLKDKVFISRDNAKNTLYLQMSKVRS EDTALYYCARGNYYRYGDAMDYWGQGTSVTVSGGGGSGGGGSAG GGSDIVLTQSPASLAVSLGQRATISCRASKSVSTSGYSYLHWYQ QKPGQPPKLLIYLASNLESGVPARFSGSGSGTDFTLNIHPVEEE DAATYYCQHSRELPFTFGSGTKLEIKGGGGSGGGGSGGGGSGLE KCFQTENPLECQDKGEEELQKYIQESQALAKRSCGLFQKLGEYY LQNAFLVAYTKKAPQLTSSELMAITRKMAATAATCCQLSEDKLL ACGEGAADIIIGHLCIRHEMTPVNPGVGQCCTSSYANRRPCFSS LVVDETYVPPAFSDDKFIFHKDLCQAQGVALQTMKQEFLINLVK QKPQITEEQLEAVIADFSGLLEKCCQGQEQEVCFAEEGQKLISK TRAALGVGGGGSGGGGSGGGGSGDIVLTQSPASLAVSLGQRATI SCRASKSVSTSGYSYLHWYQQKPGQPPKLLIYLASNLESGVPAR FSGSGSGTDFTLNIHPVEEEDAATYYCQHSRELPFTFGSGTKLE IKGGGGSGGGGSAGGGSQVQLVESGGGLVQPGGSLKLSCAASGF DFSRYWMSWVRQAPGKGLEWIGEINPTSSTINFTPSLKDKVFIS RDNAKNTLYLQMSKVRSEDTALYYCARGNYYRYGDAMDYWGQGT SVTVS |
| 1150 | α3D Q19E-p26-cc08.HIS<br>none (α3D-Q19E) — p26 — CS1 (cc08) — HIS-tag | MGSWAEFKQRLAAIKTRLEALGGSEAELAAFEKEIAAFESELQA YKGKGNPEVEALRKEAAAIRDELQAYRHNGGGGSGGGGSGGGGS GLEKCFQTENPLECQDKGEEELQKYIQESQALAKRSCGLFQKLG EYYLQNAFLVAYTKKAPQLTSSELMAITRKMAATAATCCQLSED KLLACGEGAADIIIGHLCIRHEMTPVNPGVGQCCTSSYANRRPC FSSLVVDETYVPPAFSDDKFIFHKDLCQAQGVALQTMKQEFLIN LVKQKPQITEEQLEAVIADFSGLLEKCCQGQEQEVCFAEEGQKL ISKTRAALGVGGGGSGGGGSGGGGSGMGSWVEFNERLHAIYLRL DALGGSEAELAAFEKEIAAFESELQAYKGKGNPEVETLRRHAAG IRWQLQAYRHNGGGGSGGGGSGGGGSHHHHHHHHHH |

TABLE: 5 -continued

Exemplary Adapters

| SEQ ID NO: | AdapterDesign | Adapter Sequence |
|---|---|---|
| 1151 | α3D Q19E-p26-cc01.HIS<br><br>none(α3D-Q19E) — p26 — CS1(cc01) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWVEFEARLSAIYERL<br>EALGGSEAELAAFEKEIAAFESELQAYKGKGNPEVEKLRRHAAG<br>IRSNLQAYRHNGGGGSGGGGSGGGGSHHHHHHHHHH |
| 1152 | α3D Q19E-p26-cc02.HIS<br><br>none(α3D-Q19E) — p26 — CS1(cc02) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWVEFFVRLDAIWERL<br>EALGGSEAELAAFEKEIAAFESELQAYKGKGNPEVETLRFHAAG<br>IRQHLQAYRHNGGGGSGGGGSGGGGSHHHHHHHHHH |
| 1153 | α3D Q19E-p26-cc09.HIS<br><br>none(α3D-Q19E) — p26 — CS1(cc09) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWNEFKLELAFIKDWL<br>EALGGSEAELANFEEAIAEFEAGLQGYKGKGNPEVEALRKEAAA<br>IRDELQAYRHNGGGGSGGGGSGGGGSHHHHHHHHHH |
| 1154 | α3D Q19E-p26-cc10.HIS<br><br>none(α3D-Q19E) — p26 — CS1(cc10) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWMEFEARLEAIWDRL<br>EALGGSEAELAAFEKEIAAFESELQAYKGKGNPEVESLRFHAAG<br>IRQHLQAYRHNGGGGSGGGGSGGGGSHHHHHHHHHH |
| 1155 | α3D Q19E-p26-cc12.HIS<br><br>none(α3D-Q19E) — p26 — CS1(cc12) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWHHFKMHLAGIKLQL<br>EALGGSEAELAEFEEWIADFEGALQDYKGKGNPEVEALRKEAAA<br>IRDELQAYRHNGGGGSGGGGSGGGGSHHHHHHHHHH |
| 1156 | α3D(Q19E).3xGS.p26.3xGS.α3D(Q19E).HIS<br><br>none(α3D-Q19E) — p26 — none(α3D-Q19E) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWAEFKQRLAAIKTRL<br>EALGGSEAELAAFEKEIAAFESELQAYKGKGNPEVEALRKEAAA<br>IRDELQAYRHNGGGGSGGGGSGGGGSHHHHHHHHHH |
| 1157 | α3D(Q19E).3xGS.p26.3xGS.eb03.HIS<br><br>none(α3D-Q19E) — p26 — HER2(eb03) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFJKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWAEFRWRLHAIWQL<br>GALGGSEAELAAFEKEIAAFESELQAYKGKGNPEVEWLRQDAAQ<br>IKYILQAYRHNGGGGSGGGGSGGGGSHHHHHHHHHH |

TABLE: 5 -continued

Exemplary Adapters

| SEQ ID NO: | AdapterDesign | Adapter Sequence |
|---|---|---|
| 1158 | α3D(Q19E).3xGS.p26.3xGS.eb04.HIS<br><br>none(α3D-Q19E) — p26 — HER2(eb04) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWKTFKIELAGIKLEL<br>EALGGSEAELAGFENAIAQFESSLQYYKGKGNPEVEALRKEAAA<br>IRDELQAYRHNGGGGSGGGGSGGGGSHHHHHHHHHH |
| 1159 | α3D(Q19E).3xGS.p26.3xGS.eb05.HIS<br><br>none(α3D-Q19E) — p26 — HER2(eb05) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWHEFLRRLLAIEMRL<br>YALGGSEAELAAFEKEIAAFESELQAYKGKGNPEVEHLRVRAAS<br>IRQMLQAYRHNGGGGSGGGGSGGGGSHHHHHHHHHH |
| 1160 | α3D(Q19E).3xGS.p26.3xGS.eb06.HIS<br><br>none(α3D-Q19E) — p26 — HER2(eb06) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWWEFRVRLEAIDYRL<br>KALGGSEAELAAFEKEIAAFESELQAYKGKGNPEVEYLRMKAAT<br>IRAILQAYRHNGGGGSGGGGSGGGGSHHHHHHHHHH |
| 1161 | α3D(Q19E).3xGS.p26.3xGS.eb08.HIS<br><br>none(α3D-Q19E) — p26 — HER2(eb08) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWYEFRWRLHAIWLRL<br>GALGGSEAELAAFEKEIAAFESELQAYKGKGNPEVEWLRQDAAQ<br>IRYILQAYRHNGGGGSGGGGSGGGGSHHHHHHHHHH |
| 1162 | α3D(Q19E).3xGS.p26.3xGS.eb09.HIS<br><br>none(α3D-Q19E) — p26 — HER2(eb09) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWWEFNIRLHAIDYRL<br>KALGGSEAELAAFEKEIAAFESELQAYKGKGNPEVELLREKAAQ<br>IRAQLQAYRHNGGGGSGGGGSGGGGSHHHHHHHHHH |
| 1163 | α3D(Q19E).3xGS.p26.3xGS.eb10.HIS<br><br>none(α3D-Q19E) — p26 — HER2(eb10) — HIS-tag | MGSWAEFKQRLAAIKTRLEALGGSEAELAAFEKEIAAFESELQA<br>YKGKGNPEVEALRKEAAAIRDELQAYRHNGGGGSGGGGSGGGGS<br>GLEKCFQTENPLECQDKGEEELQKYIQESQALAKRSCGLFQKLG<br>EYYLQNAFLVAYTKKAPQLTSSELMAITRKMAATAATCCQLSED<br>KLLACGEGAADIIIGHLCIRHEMTPVNPGVGQCCTSSYANRRPC<br>FSSLVVDETYVPPAFSDDKFIFHKDLCQAQGVALQTMKQEFLIN<br>LVKQKPQITEEQLEAVIADFSGLLEKCCQGQEQEVCFAEEGQKL<br>ISKTRAALGVGGGGSGGGGSGGGGSGMGSWWEFNMRLSAIKYRL<br>YALGGSEAELAAFEKEIAAFESELQAYKGKGNPEVEILRRLAAD<br>IRERLQAYRHNGGGGSGGGGSGGGGSHHHHHHHHHH |

TABLE 6

Exemplary ADBD CAR Sequences

| SEQ ID NO: | CAR Design | CAR Sequence |
|---|---|---|
| 1089 | CTsp-Flag-GSlinker-α3D(Q19E)-GSlinker-CD8H-TM-41BB-CD3ζ | MAFLWLLSCWALLGTTFGDYKDDDDKGGGGSGGGGSMGSWAEFKQRLAAIKTRLEALGGSE AELAAFEKEIAAFESELQAYKGKNPEVEALRKEAAAIRDELQAYRHNGQAGSGTTTPAPR PPTPAPTIASQPLSLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFSRSADAPAYKQGQN QLYNELNLGRREEYDVLDKRRGRDPEMGGKPRRKNPQEGLYNELQKDKMAEAYSEIGMKGE RRRGKGHDGLYQGLSTATKDTYDALHMQALPPR |
| 1090 | CTsp-Flag-GSlinker-cg06-GSlinker-CD8H-TM-41BB-CD3ζ | MAFLWLLSCWALLGTTFGDYKDDDDKGGGGSGGGGSMGSWDEFGRRLYAIEWRLYALGGSE AELAAFEKEIAAFESELQAYKGKNPEVEKLREIAAVIRSNLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1091 | CTsp-Flag-GSlinker-bc40-GSlinker-CD8H-TM-41BB-CD3ζ | MAFLWLLSCWALLGTTFGDYKDDDDKGGGGSGGGGSMGSWSEFWVRLGAIRERLDALGGSE AELAAFEKEIAAFESELQAYKGKNPEVEKLRYTAATIRRFLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1092 | CTsp-Flag-GSlinker-af03-GSlinker-CD8H-TM-41BB-CD3ζ | MAFLWLLSCWALLGTTFGDYKDDDDKGGGGSGGGGSMGSWFEFYDRLNAIDARLWALGGSE AELAAFEKEIAAFESELQAYKGKNPEVENLRVHAAAIREWLQAYRHNGGGGSGGGGSGTT TPAPRPPTPAPTIASMGSWAEFKQRLAAIKTRLEALGGSEAELAAFEKEIAAFESELQAYK GKGNPEVEALRKEAAAIRDELQAYRHNQPLSLRPEACRPAAGGAVHTRGLDFACDIYIWAP LAGTCGVLLLSLVITLYCKRGRKKLLYIFKQPFMRPVQTTQEEDGCSCRFPEEEEGGCELR VKFSRSADAPAYKQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 1093 | CTsp-Flag-GSlinker-af05-GSlinker-CD8H-TM-41BB-CD3ζ | MAFLWLLSCWALLGTTFGDYKDDDDKGGGGSGGGGSMGSWLEFYHRLNAIDSRLWALGGSE AELAAFEKEIAAFESELQAYKGKNPEVESLRDHAAHIREWLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1133 | CTsp-Flag-GSlinker-af59-GSlinker-CD8H-TM-41BB-CD3ζ | MAFLWLLSCWALLGTTFGDYKDDDDKGGGGSGGGGSMGSWFEFYDRLNAIDARLWALGGSE AELAAFEKEIAAFESELQAYKGKNPEVESLRVHAAAIREWLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1134 | CTsp-Flag-GSlinker-af83-GSlinker-CD8H-TM-41BB-CD3ζ | MAFLWLLSCWALLGTTFGDYKDDDDKGGGGSGGGGSMGSWSEFYDRLNAIDARLWALGGSE AELAAFEKEIAAFESELQAYKGKNPEVESLRVHAAAIREWLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1135 | CTsp-Flag-GSlinker-af99-GSlinker-CD8H-TM-41BB-CD3ζ | MAFLWLLSCWALLGTTFGDYKDDDDKGGGGSGGGGSMGSWFEFYDRLNAIDARLWALGGSE AELAAFEKEIAAFESELQAYKGKNPEVESLREHAAAIREWLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 1136 | CTsp-Flag-GSlinker-af101-GSlinker-CD8H-TM-41BB-CD3ζ | MAFLWLLSCWALLGTTFGDYKDDDDKGGGGSGGGGSMGSWSEFYDRLNAIDARLWALGGSE AELAAFEKEIAAFESELQAYKGKNPEVESLREHAAAIREWLQAYRHNGGGGSGGGGSGTT TPAPRPPTPAPTIASQPLSLRPEACRPAAGGAVHTRGLDFACDIYIWAPLAGTCGVLLLSL VITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |

Example 2. D-Domain CAR T Cells Kill Tumor Cells Expressing the D Domain Target The cytolytic activity of ADBD CAR expressing T cells was assessed on a panel of tumors using effector cell to target cell ratios ranging from 1:4 to 1:64. The cytolytic activity of a CD123-binding CAR (cg06, SEQ ID NO: 1090); a BCMA binding CAR (bc40, SEQ ID NO: 1091) were compared to a CAR with no known target-specificity (α3D-Q19E, SEQ ID NO: 1089).

10,000 T cells expressing the indicated CARs were incubated with increasing numbers of a CD123$^+$/BCMA$^-$ tumor target (MOLM13)(FIG. 1A); a CD123$^-$/BCMA$^+$ tumor target (H929)(FIG. 1B); a CD123$^-$ tumor target (RAJI) (FIG. 1C); or a CD123$^+$/BCMA$^-$ tumor target (MOLM13)(FIG. 1D). After 16 hours, cells were washed and luciferase activity was assessed.

Example 3. Adapter Binding Associates with Adapter and CAR Binding Specificity Jurkat NFAT-Luciferase reporter cells were transduced with a negative control CAR (α3D-Q19E, SEQ ID NO: 1089), an p26-binding CAR (af03, SEQ ID NO: 1092), or a BCMA-binding CAR (bc40, SEQ ID NO: 1091). In FIG. 2A, CAR transduced Jurkat cells were incubated with 0.5 μg of Adapter protein (SEQ ID NO: 1082-1085) at 4° C. for 20 minutes, washed, and then stained with anti-HIS PE (clone J095G46, 4° C. for 20 minutes). CAR expression based on FLAG staining (clone L5) versus mock transduced Jurkat cells was also evaluated (FIG. 2B).

Example 4. Adapter Binding of Matching CAR: Adapter and Target: Adapter Specificity Drives Lysis of Target Cells 40,000 CD123$^+$BCMA$^+$ MOLM13-GFP/Luciferase cells were incubated with various Adapters (SEQ ID NO: 1082-1084) in the presence or absence of 20,000 T cells (E:T ratio of 1:2, donor D14-053017, Day 7) transduced with BCMA-binding CAR (bc40, SEQ ID NO: 1091) for 16 hours. After 16 hours, cells were washed and luciferase activity was assessed. Percent lysis was assessed based on wells of MOLM13-GFP/Luciferase cultured in the absence of T cells or Adapter protein (see, FIG. 3A). A control of CD123-specific CAR T cells (cg06, SEQ ID NO: 1090) cultured at the same ratio was used as a positive control for lysis.

In FIG. 3B, 40,000 CD123$^+$BCMA$^-$ MOLM13-GFP/Luciferase cells were incubated with Adapter (cg06-p26, SEQ ID NO: 1084) in the presence or absence of 20,000 T cells (E:T ratio of 1:2, donor D16-061317, Day 7) transduced with p26-binding CARs (Af03, SEQ ID NO: 1092) or Af05, SEQ ID NO: 1093) for 16 hours. After 16 hours, cells were washed and luciferase activity was assessed. Percent lysis was assessed based on wells of MOLM13-GFP/Luciferase cultured in the absence of T cells or Adapter protein. A control of CD123-binding CAR T cells (cg06, SEQ ID NO: 1090) cultured at the same ratio was used as a positive control for lysis In FIG. 3C, 40,000 BCMA$^+$ NCI H929-GFP/Luciferase cells were incubated with Adapter (bc40-p26, SEQ ID NO: 1085 in the presence or absence of 10,000 T cells (E:T ratio of 1:4, donor D15-062017, Day 8) mock transduced, or transduced with p26-binding CARs (Af03, SEQ ID NO: 1092 or Af05, SEQ ID NO: 1093) for 16 hours. After 16 hours, cells were washed and luciferase activity was assessed. Percent lysis was assessed based on wells of NCI-H929-GFP/Luciferase cultured in the absence of T cells or Adapter protein.

Example 5. Adapter Binding of Matching CAR: Adapter and Target: Adapter Specificity Drives Cytokine Production by CAR T-Cells Donor D14-053017 T cells transduced with BCMA-binding CAR (bc40, SEQ ID NO: 1091) were cultured overnight with various Adapters (cg06-BCMA, SEQ ID NO: 1082; α3D-BCMA, SEQ ID NO: 1083; or cg06-p26, SEQ ID NO: 1084) in the presence or absence of CD123$^+$BCMA$^-$ MOLM13 cells (25,000 T cells and target cells). Cultured supernatants were collected and assessed for the production of IL-2 (FIG. 4A) and IFN-γ (FIG. 4B). In FIGS. 4C and 4D, donor D15-062017 T cells transduced with p26-binding CARs (Af03, SEQ ID NO: 1092 or Af05, SEQ ID NO: 1093) were cultured overnight with CD123 binding Adapter (cg06p26, SEQ ID NO: 1084) Adapter in the presence or absence of CD123$^+$BCMA$^-$ MOLM13 cells (25,000 T cells and target cells). Cultured supernatants were collected and assessed for the production of IL-2 (FIG. 4C) and IFN-γ (FIG. 4D).

Example 6. CAR T Cells Proliferate Following Exposure to an Adapter that is Bound by the CAR and Bound to a Tumor Expressing the AD Recognized by the Adapter In FIG. 5, Donor D16-062717 cells transduced with AFP-binding CAR (Af03, SEQ ID NO: 1092) were CFSE labeled (10 minutes at 0.5 μM), then cultured (25,000) in the presence of CD123-binding Adapter (cg06-p26, SEQ ID NO: 1084) or BCMA-binding Adapter (bc40-p26, SEQ ID NO: 1085) in the presence or absence of mitomycin-C treated CD123$^-$ BCMA$^+$ NCI-H929 cells (25,000) for 72 hours. At 72 hours, cells were stained for CD3, then analyzed for absolute numbers of CD3$^+$ cells via flow cytometry.

Example 7. Adapter Binding of Matching CAR: Adapter and Target: Adapter Specificity Signaling by CAR T Cells 50,000 reporter cells previously transduced with a BCMA-binding CAR (bc40, SEQ ID NO: 1091) were cultured for 5 hours in the presence of various Adapters (cg06-BCMA, SEQ ID NO: 1082; α3D-BCMA, SEQ ID NO: 1083; or cg06-p26, SEQ ID NO: 1084) in the presence or absence of 50,000 CD123$^+$BCMA$^-$ MOLM14 cells, then assessed for luciferase activity (FIG. 6A).

50,000 reporter cells previously transduced with an p26-binding CAR (af03, SEQ ID NO: 1092) were cultured for 5 hours in the presence of Adapters (α3DQ19E-BCMA, SEQ ID: 1086; bc40-p26, SEQ ID NO: 1085) in the presence or absence of 50,000 BCMA$^+$ NCI-H929 cells, then assessed for luciferase activity (FIG. 6B).

FIGS. 6A and 6B show that Adapter binding of matching CAR: Adapter and Target: Adapter drives signaling by CAR-expressing Jurkat NFAT-Luciferase reporter cells.

Example 8. Adapters Containing D Domains or ScFvs Drive CAR Cell: Adapter Mediated Lysis of Target Cells A CD123-binding Adapter with a BCMA AD (SEQ ID NO: 1082) was evaluated for its ability to function with a control CAR (α3DQ19E, SEQ ID NO: 1089), a BCMA-binding CAR (bc40, SEQ ID NO: 1091) or a BCMA-specific scFv CAR (c11D5-3) obtained from WO 2010/104949 A2.

40,000 CD123$^+$BCMA$^-$ MOLM13-GFP/Luciferase cells were incubated with the Cg06-BCMA Adapter (SEQ ID NO: 1082) in the presence or absence of 20,000 T cells (E:T ratio of 1:2, donor D14-062717, Day 9) transduced with a control CAR (SEQ ID NO: 1089), the BCMA-binding CAR (SEQ ID NO: 1091), or the BCMA-binding scFv CAR (c11D5-3) for 16 hours. After 16 hours, cells were washed and luciferase activity was assessed. Percent lysis was assessed based on wells of MOLM13-GFP/Luciferase cultured in the absence of T cells or Adapter protein. Solid lines indicate calculated 3-parameter non-linear curves, while the dashed line for c11D5-3 is present for illustrative purposes only (FIG. 7A). CD123$^+$BCMA$^-$ MOLM13-GFP/Luciferase cells were cultured in the same experiment as in FIG. 7A with transduced T cells in the absence of Adapter protein (FIG. 7B).

FIGS. 7A and 7B show that the CD123-specific Adapter with a BCMA antigenic determinant can function with either a BCMA-specific D domain CAR (bc40) or a BCMA-specific scFv CAR (c11D5-3).

Example 9. Use of Multiple Adapters Target a CAR Cell to Multiple Antigen Targets $10^5$ Jurkat NFAT-Luciferase transduced with a p26-binding CAR (af03, SEQ ID NO: 1092) were incubated with a total of 0.5 µg of Adapters (SEQ ID NO: 1084, SEQ ID NO: 1085) at the indicated ratios at 4° C. for 20 minutes, washed, and then incubated with CD123-Fc and biotinylated BCMA (0.5 µg of each/(4° C. for 20 minutes), washed, then binding detected with Anti-Fc A488 and Streptavidin-PE. FIG. 8A presents a flow cytometric analysis of CD123-binding and BCMA-binding to their respective target proteins, FIG. 8B provides a comparison of mean fluorescence intensity (MFI) of A488 MFI (CD123-binding, left axis) and PE MFI (BCMA-binding, right axis) flow cytometric data presented in FIG. 8A.

FIGS. 8A and 8B show that AFP-specific CARs can simultaneously have CD123 and BCMA-binding capacity via incubation with multiple Adapter proteins.

Example 10. Use of Dual Binding Domain Adapters to Enhance CAR Signaling 50,000 reporter cells previously transduced with an p26-binding CAR (af03, SEQ ID NO: 1092) were cultured for 5 hours in the presence of the CD123-binding Adaptor (cg06-p26, SEQ ID NO: 1084) or the bivalent Adaptor (cg06-p26-cg06, SEQ ID NO: 1087) in the presence of 50,000 CD123$^+$ MOLM13 or CD123-deficient MOLM13 cells, then assessed for luciferase activity. CD123 deficient cells were generated using CRISPR/Cas9 genetic engineering technology (FIG. 9A). 50,000 reporter cells previously transduced with an p26-binding CAR (af03, SEQ ID NO: 1092) were cultured for 5 hours in the presence of the BCMA-binding Adaptor (bc40-p26, SEQ ID NO: 1085) or the bivalent Adapter ((bc40-p26-bc40, SEQ ID NO: 1088) in the presence or absence of 50,000 BCMA$^+$ U266 cells, then assessed for luciferase activity (FIG. 9B).

FIGS. 9A and 9B show that dual-binding domain adaptor proteins drive enhanced signaling by CAR-expressing Jurkat cells over single-binding domain adaptor proteins.

Example 11. CD45 Specific D-Domain CAR T Cells Kill CD45 Expressing Target Cells T-cells will be transduced with a CAR comprising a CD45 specific D domain CD45− CAR T-cells expressing a CAR comprising a human CD45 specific D domain will be generated using CRISPR/Cas9 genetic engineering technology. CD45 specific gRNA and crRNA and Cas9 will be obtained from commercial sources. The self-lysing activity of the CD45− CAR T cells will be assessed using assays for cell proliferation, viability and/or cytotoxicity, for example 7-AAD staining and chromium release assay. Self-lysing of CD45− CAR T-cells will be compared to CD45+ control CAR T-cells expressing the same CAR comprising the CD45 specific D domain.

The cytolytic activity of CD45− T cells expressing a CAR comprising a human CD45 specific D domain will be assessed on a panel of CD45+ target cells using effector cell to target cell ratios ranging from 1:4 to 1:64. The cytolytic activity of the CD45− CAR T cells will be compared to a CAR with no known target-specificity.

Example 12. CD45 Specific Adapter Directed Lysis of Target Cells

CD45− CAR T-cells will be generated using CRISPR/Cas9 genetic engineering technology. CD45 specific gRNA and crRNA and Cas9 will be obtained from commercial sources. The self-lysing activity of the CD45− CAR T cells will be assessed using assays for cell proliferation, viability and/or cytotoxicity, for example 7-AAD staining and chromium release assay. Self-lysing of CD45− CAR T-cells will be compared to CD45+ control CAR T-cells.

The cytolytic activity of CD45− T cells expressing a CAR comprising a human CD45 specific D domain will be assessed on a panel of CD45+ target cells using effector cell to target cell ratios ranging from 1:4 to 1:64. The cytolytic activity of the CD45− CAR T cells will be compared to a CAR with no known target-specificity.

CD45+ target cells will be incubated with various Adapters comprising a CD45 specific D domain and p26 in the presence or absence of CD45− T cells transduced with a p26-binding CAR for 16 hours. After 16 hours, cells will be washed and luciferase activity will be assessed. Percent lysis will be assessed based on wells of target cells cultured in the absence of T cells or Adapter protein. A control of CD45-specific CAR T cells cultured at the same ratio will be used as a positive control for lysis.

Example 13. Adapter Comprising Truncated p26 have Improved Bioactivity in Cytotoxicity Assay Analysis of p26 structure revealed an N-terminal stretch of residues that were predicted to increase the potential for aggregation and/or proteolysis. This N-terminal sequence also contains a predicted disulfide bond pair, which could potentially destabilize the protein if the cysteines are un-paired, or reinforce a suboptimal protein conformation if the disulfide bond is formed. To eliminate these potential developmental liabilities, N-terminal truncated variants of p26 were prepared. In p26(G17-V229) (SEQ ID NO: 1118) the first 16 residues of p26 were removed to eliminate the disulfide pair of cysteines (C4-C13). In p26(K23-V229) (SEQ ID NO: 1120) the first 22 residues of p26 were removed to additionally eliminate the beginning of a predicted albumin 3 domain. In p26(Q26-V229) the first 25 residues were removed to eliminate two hydrophobic residues (YI) beyond the K23 truncation and thus make the N-terminus flush with the predicted globular region of p26. The binding of full length and truncated p26 to FcRn was assessed using ELISA. Adapters comprising full-length p26 or the truncated p26(Q26-V229) variant bind to FcRn in a pH dependent manner, with higher binding affinity observed at pH 6.0 than at pH 7.4.

The bioactivity of Adapters comprising full length p26 or the truncated p26(G17-V229), p26(K23-V229) or p26(Q26-V229) variants were tested in various Luciferase-based Cytotoxicity Assays. Surprisingly, Adapters comprising truncated p26 had higher bioactivity than Adapters comprising full-length p26.

40,000 BCMA+ NALM6/Luciferase cells were incubated with Adapters BCMA(bc98)-p26 JPE (SEQ ID NO: 1124), BCMA(bc98)-p26 (SEQ ID NO: 1125), BCMA(bc98)-p26 (Q26-V229) (SEQ ID NO: 1126), BCMA(bc98)-p26(K23-V229) (SEQ ID NO: 1127), or BCMA(bc98)-p26(G17-V229) (SEQ ID NO: 1128), in the presence of 10,000 T cells (E:T ratio of 1:4) transduced with a p26-binding CAR (Af59, SEQ ID NO: 1133) for 16 hours. After 16 hours, cells were washed and luciferase activity was assessed. Percent lysis was assessed based on wells of NALM6/Luciferase cultured in the absence of T cells or Adapter protein. Adapters comprising the truncated p26 variants had higher bioactivity than the Adapters comprising the full-length p26. The EC50 values measured for the Adaptors were as follows:

| Adapter | EC50 |
| --- | --- |
| BCMA(bc98)-p26 JPE | 1.135 |
| BCMA(bc98)-p26 | 1.962 |
| BCMA(bc98)-p26(Q26-V229) | 0.1294 |
| BCMA(bc98)-p26(K23-V229) | 0.2232 |
| BCMA(bc98)-p26(G17-V229) | 0.367 |

40,000 BCMA+ NCI H929/Luciferase cells were incubated with Adapters BCMA(bc98)-p26 JPE (SEQ ID NO: 1124), BCMA(bc98)-p26 (SEQ ID NO: 1125), BCMA(bc98)-p26(Q26-V229) (SEQ ID NO: 1126), BCMA(bc98)-p26(K23-V229) (SEQ ID NO: 1127), or BCMA(bc98)-p26(G17-V229) (SEQ ID NO: 1128), in the presence of 10,000 T cells (E:T ratio of 1:4) transduced with a p26-binding CAR (Af59, SEQ ID NO: 1133) for 16 hours. After 16 hours, cells were washed and luciferase activity was assessed. Percent lysis was assessed based on wells of NCI-H929/Luciferase cultured in the absence of T cells or Adapter protein. Adapters comprising the truncated p26 variants had higher bioactivity than the Adapters comprising the full-length p26. The EC50 values measured for the Adaptors were as follows:

| Adapter | EC50 |
| --- | --- |
| BCMA(bc98)-p26 JPE | 0.367 |
| BCMA(bc98)-p26 | 0.3869 |
| BCMA(bc98)-p26(Q26-V229) | 0.04357 |
| BCMA(bc98)-p26(K23-V229) | 0.06069 |
| BCMA(bc98)-p26(G17-V229) | 0.1318 |

The presence of the Q127P substitution in the truncated p26 did not alter the Adapter's bioactivity. 40,000 BCMA+ NCI H929/Luciferase cells were incubated with Adapters BCMA(bc98)-p26 (SEQ ID NO: 1124), BCMA(bc98)-p26 (Q26-V229) (SEQ ID NO: 1126), or BCMA(bc98)-p26 (Q26-V229)Q217P (SEQ ID NO: 1131), in the presence of 10,000 T cells (E:T ratio of 1:4) transduced with a p26-binding CAR (Af59, SEQ ID NO: 1133) for 16 hours. After 16 hours, cells were washed and luciferase activity was assessed. Percent lysis was assessed based on wells of NCI-H929/Luciferase cultured in the absence of T cells or Adapter protein. Adapters comprising the truncated p26 variants had higher bioactivity than the Adapters comprising the full-length p26. Adapters comprising the truncated p26 variants with or without the Q217P substitution had substantially the same bioactivity. The EC50 values measured were as follows:

| Adapter | EC50 |
| --- | --- |
| BCMA(bc98)-p26 | 0.5243 |
| BCMA(bc98)-p26(Q26-V229) | 0.1142 |
| BCMA(bc98)-p26(Q26-V229)Q217P | 0.143 |

Bivalent Adapters comprising a truncated p26 variant also performed better than a corresponding Adapter comprising full-length p26. 40,000 BCMA+ NCI H929/Luciferase cells were incubated with Adapters BCMA(bc98)-p26-BCMA(bc98) (SEQ ID NO: 1129), BCMA(bc98)-p26(Q26-V229)-BCMA(bc98) (SEQ ID NO: 1132), or BCMA(bc98)-p26(Q26-V229)Q217P-BCMA(bc98) (SEQ ID NO: 1130), in the presence of 10,000 T cells (E:T ratio of 1:4) transduced with a p26-binding CAR (Af59, SEQ ID NO: 1133) for 16 hours. After 16 hours, cells were washed and luciferase activity was assessed. Percent lysis was assessed based on wells of NCI-H929/Luciferase cultured in the absence of T cells or Adapter protein. Adapters comprising the truncated p26 variants had higher bioactivity than the Adapters comprising the full-length p26. Adapters comprising the truncated p26 variants with or without the Q217P substitution had substantially the same bioactivity. The EC50 values measured for the Adaptors were as follows:

| Adapter | EC50 |
| --- | --- |
| BCMA(bc98)-p26-BCMA(bc98) | 0.008227 |
| BCMA(bc98)-p26(Q26-V229)-BCMA(bc98) | 0.00256 |
| BCMA(bc98)-p26(Q26-V229)Q217P-BCMA(bc98) | 0.001812 |

Example 14. Binding of Truncated and Full Length p26 to Human FcRn is pH Dependent The binding of full length and truncated p26 to FcRn was assessed using an ELISA format in which wells of 96-well plate were coated with adapter (bc40-p26 (SEQ ID NO:1085), bc98-p26(Q26-V229)-bc98 (SEQ ID NO:1132), HSA, bc40 (SEQ ID NO:197 with HIS-tag) or uncoated) overnight at 4° C. Wells were then blocked with PBS+1% fish gelatin for 1 hour at 22° C. Parallel wells were then washed with PBS+0.1% Tween at pH 6.0 or 7.4. Biotinylated human FcRn in PBS+1% fish gelatin (either pH 6.0 or 7.4) was serially diluted and added to wells and incubated for 1 hour at 22° C. After washing with PBS+0.1% Tween at pH 6.0 or 7.4, streptavidin-HRP (in PBS+1% fish gelatin at pH 6.0 or 7.4) was added. After a final wash, signal was developed using TMB reagent and quantified by reading absorbance at A450. As shown in FIG. 10, adapters comprising full-length p26 or the truncated p26(Q26-V229) variant bind to FcRn in a pH dependent manner, with higher binding affinity observed at pH 6.0 than at pH 7.4.

Example 15. Adapters Comprising CS1 (SLAMF7, CRACC, CD319) Specific ADBD Modulate Intracellular Signaling and Killing of CS1 Positive Tumors CS1 binding domains (ADBD) were isolated by panning ADBD phage libraries on the extracellular domain of human CS1 protein. Representative CS1 binding ADBD were fused to p26 in a bispecific format with non-binding α3DQ19E (SEQ ID NO: 1021) to generate adapter proteins for functional testing in combination with af59-CAR (SEQ ID NO:1133) expressing JNL10 cells or human T cells expressing af59-CAR.

| CS1 (SLAMF7, CRACC, CD319) Adapter Constructs | Adapter SEQ ID NO: | CS1 ADBD SEQ ID NO: | CS1 ADBD clone ID |
|---|---|---|---|
| □3D Q19E-p26-cc08.HIS | 1500 | 787 | cc08 |
| □3D Q19E-p26-cc01.HIS | 1501 | 780 | cc01 |
| □3D Q19E-p26-cc02.HIS | 1502 | 781 | cc02 |
| □3D Q19E-p26-cc09.HIS | 1503 | 788 | cc09 |
| □3D Q19E-p26-cc10.HIS | 1504 | 789 | cc10 |
| □3D Q19E-p26-cc12.HIS | 1505 | 791 | cc12 |

Among the adapters tested in, the cc02 and cc08 ADBD displayed the most potent NFAT signaling when cultured in the presence of af59-CAR expressing JNL10 cells and the CS1 positive tumor cell line, MM.1S (FIG. 11A).

The cc02 CS1 ADBD (SEQ ID NO: 781) was fused to p26 and either the non-binding α3DQ19E DD (SEQ ID NO: 1021) or the BCMA-binding bc98 DD (SEQ ID NO: 201). The ability of the resulting adapters to induce signaling in af59-CAR expressing JNL10 cells in the presence of the BCMA positive and CS1 positive cell line, MM.1S was assessed. As shown in FIG. 11B, the bispecific bc98-p26-cc02 adapter capable of binding both CS1 and BCMA was more potent in its ability to signal than were the monospecific BCMA-binding bc98-p26-α3DQ19E adapter and the monospecific CS1-binding α3DQ19E-p26-cc02 adapter.

The af59-CAR (SEQ ID NO: 1133) was transduced into normal human T cells and the ability of those cells to kill H929 (BCMA++, CS1+) and MM.1S (BCMA++, CS1++) tumors using the indicated adapters was assessed. The data shown in FIGS. 11C and D indicate the bispecific bc98-p26-cc02 is an effective adapter in killing HT929 (high expression of both BCMA and CS1) and MM.1S (high BCMA, low CS1).

Example 16. Adapters Comprising HER2 Binding ADBD Induce Signaling in Af59-CAR Expressing JNL10-Cells Cultured with HER2-Positive SKBR3 Tumor Cells α3D(Q19E)-p26-Eb(08), or Affibody/Darpin-Based Adaptors HER2 (ERBB2, CD340) binding domains (ADBD) were isolated by panning ADBD phage libraries on the extracellular domain of human HER2 protein. Representative HER2 binding ADBD were fused to p26 in a bispecific format with non-binding α3DQ19E (SEQ ID NO: 1021) to generate adapter proteins for functional testing in combination with af59-CAR (SEQ ID NO:1133) expressing JNL10 cells or human T cells expressing af59-CAR.

| HER2 (erbB2) Adapter Constructs | Adapter Construct SEQ ID NO: | HER2 ADBD SEQ ID NO: | ADBD clone ID |
|---|---|---|---|
| α3D(Q19E).3xGS.p26.3xGS. α3D(Q19E).HIS | 1506 | N/A | N/A |
| α3D(Q19E).3xGS.p26.3xGS.eb03.HIS | 1507 | 804 | eb03 |
| α3D(Q19E).3xGS.p26.3xGS.eb04.HIS | 1508 | 814 | eb04 |
| α3D(Q19E).3xGS.p26.3xGS.eb05.HIS | 1509 | 810 | eb05 |
| α3D(Q19E).3xGS.p26.3xGS.eb06.HIS | 1510 | 834 | eb06 |
| α3D(Q19E).3xGS.p26.3xGS.eb08.HIS | 1511 | 809 | eb08 |
| α3D(Q19E).3xGS.p26.3xGS.eb09.HIS | 1512 | 833 | eb09 |
| α3D(Q19E).3xGS.p26.3xGS.eb10.HIS | 1513 | 839 | eb10 |

The adapters demonstrated a range of activities in their ability to induce JNL10 NFAT signaling when cultured in the presence of af59-CAR expressing JNL10 cells and HER2 positive SKBR3 tumor cells. As shown in FIG. 12A, the adapter comprising eb08 was the most potent stimulator in this assay.

The adapter comprising eb08 was then compared to other adapters containing a HER2 binding domains derived from affibodies (zHER2(4) and zHER2(342)) or DARPins (9.29 and G3). As shown in FIG. 12B, the NFAT signaling in JNL10 cells mediated by the adapter comprising eb08 is greater than that of mediated by the adapter comprising zHERs:4, comparable to that of mediated by the adapter comprising 9.29, and less than that of G3 and zHER2:342.

The ability of adapters comprising the HER2-binding eb08 and eb04 domain to induce tumor (SKBR3) kill was compared with adapters containing other HER2 binding domains derived from affibodies (zHER2(4) and zHER2(342)) or DARPins (9.29 and G3). Each adapter was incubated with normal human T cells transduced with af59-CAR that binds p26 found in each adapter. SKBR3 lysis was quantitated in a 16-hour luciferase-based assay at an effector to target ratio of 1:5. The results of the assay shown in FIG. 12C demonstrate that adapters comprising eb08 or eb04 modulate tumor lysis in a dose-dependent manner.

Throughout this application, various publications are referenced by author name and date, or by Patent No. or Patent Publication No. The disclosure of these publications are hereby incorporated in their entireties by reference into this application in order to more fully describe the state of the art as known to those skilled therein as of the date of the invention described and claimed herein. However, the citation of a reference herein should not be construed as an acknowledgement that such reference is prior art to the present invention.

SEQUENCE LISTING (1163 sequences)

SEQ ID NO: 1 - protein, 73 aa, Artificial sequence
  artificial construct
MGSWAEFKQRLAAIKTRLQALGGSEAELAAFEKEIAAFESELQAYKGKGNPEVEALRKEAAAIRDELQAYRHN

SEQ ID NO: 2 - protein, 291 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 3 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 4 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 5 - protein, 54 aa, Homo sapiens
MLQMAGQCSQNEYFDSLLHACIPCQLRCSSNTPPLTCQRYCNASVTNSVKGTNA

SEQ ID NO: 6 - protein, 7 aa, Homo sapiens
AGIYAPI

SEQ ID NO: 7 - protein, 15 aa, Homo sapiens
FLKMESLNFIRAHTP

SEQ ID NO: 8 - protein, 8 aa, Homo sapiens
EPANPSEK

SEQ ID NO: 9 - protein, 47 aa, Homo sapiens
KISHFLKMESLNFIRAHTPYINIYNCEPANPSEKNSPSTQYCYSIQS

SEQ ID NO: 10 - protein, 6 aa, Homo sapiens
PICVTV

SEQ ID NO: 11 - protein, 287 aa, Homo sapiens
TKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWR

SEQ ID NO: 12 - protein, 21 aa, Homo sapiens
DKTSFVSFVGLAFVPLQIWSK

SEQ ID NO: 13 - protein, 130 aa, Homo sapiens
RAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNN

SEQ ID NO: 14 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 15 - protein, 591 aa, Homo sapiens
RTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 16 - protein, 229 aa, Artificial sequence
  artificial construct
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 17 - protein, 73 aa, Artificial sequence
  artificial construct
  MISC_FEATURE (5)..(6): Xaa can be any natural and non-natural amino acid
  MISC_FEATURE (9)..(10): Xaa can be any natural and non-natural amino acid
  MISC_FEATURE (13)..(13): Xaa can be any natural and non-natural amino acid
  MISC_FEATURE (16)..(17): Xaa can be any natural and non-natural amino acid
  MISC_FEATURE (30)..(30): Xaa can be any natural and non-natural amino acid
  MISC_FEATURE (33)..(34): Xaa can be any natural and non-natural amino acid
  MISC_FEATURE (37)..(37): Xaa can be any natural and non-natural amino acid
  MISC_FEATURE (40)..(41): Xaa can be any natural and non-natural amino acid
  MISC_FEATURE (44)..(44): Xaa can be any natural and non-natural amino acid
MGSWXXFKXXLAXIKXXLEALGGSEAELAXFEXXIAXFEXXLQXYKGKGNPEVEALRKEAAAIRDELQAYRHN

SEQ ID NO: 18 - protein, 73 aa, Artificial sequence
  artificial construct
  MISC_FEATURE (32)..(33): Xaa can be any natural and non-natural amino acid
  MISC_FEATURE (36)..(36): Xaa can be any natural and non-natural amino acid
  MISC_FEATURE (39)..(40): Xaa can be any natural and non-natural amino acid
  MISC_FEATURE (43)..(43): Xaa can be any natural and non-natural amino acid
  MISC_FEATURE (57)..(58): Xaa can be any natural and non-natural amino acid
  MISC_FEATURE (61)..(61): Xaa can be any natural and non-natural amino acid
  MISC_FEATURE (64)..(65): Xaa can be any natural and non-natural amino acid
  MISC_FEATURE (68)..(68): Xaa can be any natural and non-natural amino acid
MGSWAEFKQRLAAIKTRLEALGGSEAELAAFXXEIXAFXXELXAYKGKGNPEVEALXXEAXAIXXELXAYRHN

SEQ ID NO: 19 - protein, 73 aa, Artificial sequence
  artificial construct
  MISC_FEATURE (5)..(5): Xaa can be any natural and non-natural amino acid
  MISC_FEATURE (8)..(9): Xaa can be any natural and non-natural amino acid
  MISC_FEATURE (12)..(12): Xaa can be any natural and non-natural amino acid
  MISC_FEATURE (15)..(16): Xaa can be any natural and non-natural amino acid
  MISC_FEATURE (19)..(19): Xaa can be any natural and non-natural amino acid
  MISC_FEATURE (55)..(55): Xaa can be any natural and non-natural amino acid
  MISC_FEATURE (58)..(59): Xaa can be any natural and non-natural amino acid
  MISC_FEATURE (62)..(62): Xaa can be any natural and non-natural amino acid
  MISC_FEATURE (65)..(66): Xaa can be any natural and non-natural amino acid
MGSWXEFXXRLXAIXXRLXALGGSEAELAAFEKEIAAFESELQAYKGKGNPEVEXLRXXAAXIRXXLQAYRHN

SEQ ID NO: 20 - protein, 73 aa, Artificial sequence
  artificial construct
  MISC_FEATURE (5)..(6): Xaa can be any natural and non-natural amino acid
  MISC_FEATURE (9)..(10): Xaa can be any natural and non-natural amino acid
  MISC_FEATURE (13)..(13): Xaa can be any natural and non-natural amino acid
  MISC_FEATURE (16)..(17): Xaa can be any natural and non-natural amino acid
  MISC_FEATURE (32)..(33): Xaa can be any natural and non-natural amino acid
  MISC_FEATURE (36)..(36): Xaa can be any natural and non-natural amino acid
  MISC_FEATURE (39)..(40): Xaa can be any natural and non-natural amino acid
  MISC_FEATURE (43)..(43): Xaa can be any natural and non-natural amino acid
  MISC_FEATURE (50)..(50): Xaa can be any natural and non-natural amino acid
  misc_feature (55)..(55): Xaa can be any naturally occurring amino acid
  MISC_FEATURE (58)..(59): Xaa can be any natural and non-natural amino acid
  MISC_FEATURE (62)..(62): Xaa can be any natural and non-natural amino acid
  MISC_FEATURE (65)..(66): Xaa can be any natural and non-natural amino acid
MGSWXXFKXXLAXIKXXLEALGGSEAELAAFXXEIXAFXXELXAYKGKGNPEVEXLRXXAAXIRXXLQAYRHN

SEQ ID NO: 21 - protein, 73 aa, Artificial sequence
  artificial construct
  MISC_FEATURE (5)..(5): Xaa can be any natural and non-natural amino acid
  MISC_FEATURE (8)..(9): Xaa can be any natural and non-natural amino acid
  MISC_FEATURE (12)..(12): Xaa can be any natural and non-natural amino acid
  MISC_FEATURE (15)..(16): Xaa can be any natural and non-natural amino acid
  MISC_FEATURE (19)..(19): Xaa can be any natural and non-natural amino acid
  MISC_FEATURE (30)..(30): Xaa can be any natural and non-natural amino acid
  MISC_FEATURE (33)..(34): Xaa can be any natural and non-natural amino acid
  MISC_FEATURE (37)..(37): Xaa can be any natural and non-natural amino acid
  MISC_FEATURE (40)..(41): Xaa can be any natural and non-natural amino acid
  MISC_FEATURE (44)..(44): Xaa can be any natural and non-natural amino acid
  MISC_FEATURE (57)..(58): Xaa can be any natural and non-natural amino acid
  MISC_FEATURE (61)..(61): Xaa can be any natural and non-natural amino acid
  MISC_FEATURE (64)..(65): Xaa can be any natural and non-natural amino acid
  MISC_FEATURE (68)..(68): Xaa can be any natural and non-natural amino acid
MGSWXEFXXRLXAIXXRLXALGGSEAELAXFEXXIAXFEXXLQXYKGKGNPEVEALXXEAXAIXXELXAYRHN

SEQ ID NO: 22 - protein, 126 aa, Artificial sequence
  artificial construct
  MISC_FEATURE (5)..(6): Xaa can be any natural and non-natural amino acid
  MISC_FEATURE (9)..(10): Xaa can be any natural and non-natural amino acid
  MISC_FEATURE (13)..(13): Xaa can be any natural and non-natural amino acid
  MISC_FEATURE (16)..(17): Xaa can be any natural and non-natural amino acid
  VARIANT (22)..(51): Xaa is 2-30 natural and/or non-natural amino acid residues and up to 28 positions may be absent
  MISC_FEATURE (57)..(57): Xaa can be any natural and non-natural amino acid
  MISC_FEATURE (60)..(61): Xaa can be any natural and non-natural amino acid
  MISC_FEATURE (64)..(64): Xaa can be any natural and non-natural amino acid
  MISC_FEATURE (67)..(67): Xaa can be any natural and non-natural amino acid
  misc_feature (68)..(68): Xaa can be any naturally occurring amino acid
  MISC_FEATURE (71)..(71): Xaa can be any natural and non-natural amino acid
  VARIANT (73)..(102): Xaa is 2-30 natural and/or non-natural amino acid residues and up to 28 positions may be absent
MGSWXXFKXXLAXIKXXLEALXXXXXXXXXXXXXXXXXXXXXXXXXXXXXXEAELAXFEXXIAXFEXXLQXYXXXXXXXXXXXXXXXXXXXXXXXXXXXXXXNPEVEALRKEAAAIRDELQAYRHN

SEQ ID NO: 23 - protein, 126 aa, Artificial sequence
  artificial construct
  VARIANT (22)..(51): Xaa is 2-30 natural and/or non-natural amino acid residues and up to 28 positions may be absent
  MISC_FEATURE (59)..(60): Xaa can be any natural and non-natural amino acid
  MISC_FEATURE (63)..(63): Xaa can be any natural and non-natural amino acid
  MISC_FEATURE (66)..(67): Xaa can be any natural and non-natural amino acid
  MISC_FEATURE (70)..(70): Xaa can be any natural and non-natural amino acid
  VARIANT (73)..(102): Xaa is 2-30 natural and/or non-natural amino acid residues and up to 28 positions may be absent
  MISC_FEATURE (110)..(111): Xaa can be any natural and non-natural amino acid
  MISC_FEATURE (114)..(114): Xaa can be any natural and non-natural amino acid
  MISC_FEATURE (117)..(118): Xaa can be any natural and non-natural amino acid
  MISC_FEATURE (121)..(121): Xaa can be any natural and non-natural amino acid
MGSWAEFKQRLAAIKTRLEALXXXXXXXXXXXXXXXXXXXXXXXXXXXXXXEAELAAFXXEIXAFXXELXAYXXXXXXXXXXXXXXXXXXXXXXXXXXXXXXNPEVEALXXEAXAIXXELXAYRHN

SEQ ID NO: 24 - protein, 126 aa, Artificial sequence
  artificial construct
  MISC_FEATURE (5)..(5): Xaa can be any natural and non-natural amino acid
  MISC_FEATURE (8)..(9): Xaa can be any natural and non-natural amino acid
  MISC_FEATURE (12)..(12): Xaa can be any natural and non-natural amino acid
  MISC_FEATURE (15)..(16): Xaa can be any natural and non-natural amino acid
  MISC_FEATURE (19)..(19): Xaa can be any natural and non-natural amino acid
  VARIANT (22)..(51): Xaa is 2-30 natural and/or non-natural amino acid residues and up to 28 positions may be absent
  VARIANT (73)..(102): Xaa is 2-30 natural and/or non-natural amino acid residues and up to 28 positions may be absent
  MISC_FEATURE (108)..(108): Xaa can be any natural and non-natural amino acid
  MISC_FEATURE (111)..(112): Xaa can be any natural and non-natural amino acid
  MISC_FEATURE (115)..(115): Xaa can be any natural and non-natural amino acid
  MISC_FEATURE (118)..(119): Xaa can be any natural and non-natural amino acid
MGSWXEFXXRLXAIXXRLXALXXXXXXXXXXXXXXXXXXXXXXXXXXXXXXEAELAAFEKEIAAFESELQAYXXXXXXXXXXXXXXXXXXXXXXXXXXXXXXNPEVEXLRXXAAXIRXXLQAYRHN

SEQ ID NO: 25 - protein, 126 aa, Artificial sequence
  artificial construct
  MISC_FEATURE (5)..(6): Xaa can be any natural and non-natural amino acid
  MISC_FEATURE (9)..(10): Xaa can be any natural and non-natural amino acid
  MISC_FEATURE (13)..(13): Xaa can be any natural and non-natural amino acid
  MISC_FEATURE (16)..(17): Xaa can be any natural and non-natural amino acid
  VARIANT (22)..(51): Xaa is 2-30 natural and/or non-natural amino acid residues and up to 28 positions may be absent
  MISC_FEATURE (59)..(60): Xaa can be any natural and non-natural amino acid
  MISC_FEATURE (63)..(63): Xaa can be any natural and non-natural amino acid
  MISC_FEATURE (66)..(67): Xaa can be any natural and non-natural amino acid
  MISC_FEATURE (70)..(70): Xaa can be any natural and non-natural amino acid
  VARIANT (73)..(102): Xaa is 2-30 natural and/or non-natural amino acid residues and up to 28 positions may be absent
  MISC_FEATURE (108)..(108): Xaa can be any natural and non-natural amino acid
  MISC_FEATURE (111)..(112): Xaa can be any natural and non-natural amino acid
  MISC_FEATURE (115)..(115): Xaa can be any natural and non-natural amino acid
  MISC_FEATURE (118)..(119): Xaa can be any natural and non-natural amino acid
MGSWXXFKXXLAXIKXXLEALXXXXXXXXXXXXXXXXXXXXXXXXXXXXXXEAELAAFXXEIXAFXXELXAYXXXXXXXXXXXXXXXXXXXXXXXXXXXXXXNPEVEXLRXXAAXIRXXLQAYRHN

SEQ ID NO: 26 - protein, 126 aa, Artificial sequence
  artificial construct
  MISC_FEATURE (5)..(5): Xaa can be any natural and non-natural amino acid
  MISC_FEATURE (8)..(9): Xaa can be any natural and non-natural amino acid
  MISC_FEATURE (12)..(12): Xaa can be any natural and non-natural amino acid
  MISC_FEATURE (15)..(16): Xaa can be any natural and non-natural amino acid
  MISC_FEATURE (19)..(19): Xaa can be any natural and non-natural amino acid
  VARIANT (22)..(51): Xaa is 2-30 natural and/or non-natural amino acid residues and up to 28 positions may be absent
  MISC_FEATURE (57)..(57): Xaa can be any natural and non-natural amino acid
  MISC_FEATURE (60)..(61): Xaa can be any natural and non-natural amino acid
  MISC_FEATURE (64)..(64): Xaa can be any natural and non-natural amino acid
  MISC_FEATURE (67)..(68): Xaa can be any natural and non-natural amino acid
  MISC_FEATURE (71)..(71): Xaa can be any natural and non-natural amino acid
  VARIANT (73)..(102): Xaa is 2-30 natural and/or non-natural amino acid residues and up to 28 positions may be absent
  MISC_FEATURE (110)..(111): Xaa can be any natural and non-natural amino acid
  MISC_FEATURE (114)..(114): Xaa can be any natural and non-natural amino acid
  MISC_FEATURE (117)..(118): Xaa can be any natural and non-natural amino acid
  MISC_FEATURE (121)..(121): Xaa can be any natural and non-natural amino acid
MGSWXEFXXRLXAIXXRLXALXXXXXXXXXXXXXXXXXXXXXXXXXXXXXXEAELAXFEXXIAXFEXXLQXYXXXXXXXXXXXXXXXXXXXXXXXXXXXXXXNPEVEALXXEAXAIXXELXAYRHN

SEQ ID NO: 27 - protein, 73 aa, Artificial sequence
  artificial construct
  MISC_FEATURE (5)..(5): Xaa can be any natural and non-natural amino acid
  MISC_FEATURE (8)..(9): Xaa can be any natural and non-natural amino acid
  MISC_FEATURE (12)..(13): Xaa can be any natural and non-natural amino acid
  MISC_FEATURE (15)..(16): Xaa can be any natural and non-natural amino acid
  MISC_FEATURE (19)..(19): Xaa can be any natural and non-natural amino acid
  MISC_FEATURE (36)..(36): Xaa can be any natural and non-natural amino acid
  MISC_FEATURE (39)..(40): Xaa can be any natural and non-natural amino acid
  MISC_FEATURE (43)..(43): Xaa can be any natural and non-natural amino acid
  MISC_FEATURE (58)..(58): Xaa can be any natural and non-natural amino acid
  MISC_FEATURE (61)..(62): Xaa can be any natural and non-natural amino acid
  MISC_FEATURE (65)..(65): Xaa can be any natural and non-natural amino acid
  MISC_FEATURE (68)..(69): Xaa can be any natural and non-natural amino acid
  MISC_FEATURE (72)..(73): Xaa can be any natural and non-natural amino acid
MGSWXEFXXRLXXIXXRLXALGGSEAELAAFEKEIXAFXXELXAYKGKGNPEVEALRXEAXXIRXELXXYRXX

SEQ ID NO: 28 - protein, 58 aa, Artificial sequence
  artificial construct
  MISC_FEATURE (9)..(11): Xaa can be any natural and non-natural amino acid
  MISC_FEATURE (13)..(14): Xaa can be any natural and non-natural amino acid
  MISC_FEATURE (17)..(18): Xaa can be any natural and non-natural amino acid
  MISC_FEATURE (24)..(25): Xaa can be any natural and non-natural amino acid
  MISC_FEATURE (27)..(28): Xaa can be any natural and non-natural amino acid
  MISC_FEATURE (32)..(32): Xaa can be any natural and non-natural amino acid
  MISC_FEATURE (35)..(35): Xaa can be any natural and non-natural amino acid
VDNKFNKEXXXAXXEIXXLPNLNXXQXXAFIXSLXDDPSQSANLLAEAKKLNDAQAPK

SEQ ID NO: 29 - protein, 33 aa, Artificial sequence
  artificial construct
  MISC_FEATURE (4)..(6): Xaa can be any natural and non-natural amino acid
  MISC_FEATURE (8)..(9): Xaa can be any natural and non-natural amino acid
  MISC_FEATURE (12)..(13): Xaa can be any natural and non-natural amino acid
  MISC_FEATURE (19)..(20): Xaa can be any natural and non-natural amino acid
  MISC_FEATURE (22)..(23): Xaa can be any natural and non-natural amino acid
  MISC_FEATURE (27)..(27): Xaa can be any natural and non-natural amino acid
  MISC_FEATURE (30)..(30): Xaa can be any natural and non-natural amino acid
NKEXXXAXXEIXXLPNLNXXQXXAFIXSLXDDP

SEQ ID NO: 30 - protein, 33 aa, Artificial sequence
  artificial construct
  MISC_FEATURE (2)..(3): Xaa is any amino acid but Cys, Arg, or Pro
  MISC_FEATURE (5)..(5): Xaa is any amino acid but Cys, Arg, or Pro
  MISC_FEATURE (13)..(14): Xaa is any amino acid but Cys, Arg, or Pro
  MISC_FEATURE (26)..(26): Xaa is His, Asn, or Tyr
  MISC_FEATURE (33)..(33): Xaa is any amino acid but Cys, Arg, or Pro
DXXGXTPLHLAAXXGHLEIVEVLLKXGADVNAX

SEQ ID NO: 31 - protein, 166 aa, Artificial sequence
  artificial construct
  MISC_FEATURE (44)..(45): Xaa is any amino acid but Cys, Arg, or Pro
  MISC_FEATURE (47)..(47): Xaa is any amino acid but Cys, Arg, or Pro
  MISC_FEATURE (55)..(56): Xaa is any amino acid but Cys, Arg, or Pro
  MISC_FEATURE (68)..(68): Xaa is His, Asn, or Tyr
  MISC_FEATURE (75)..(75): Xaa is any amino acid but Cys, Arg, or Pro
  MISC_FEATURE (77)..(78): Xaa is any amino acid but Cys, Arg, or Pro
  MISC_FEATURE (80)..(80): Xaa is any amino acid but Cys, Arg, or Pro
  MISC_FEATURE (88)..(89): Xaa is any amino acid but Cys, Arg, or Pro
  MISC_FEATURE (101)..(101): Xaa is His, Asn, or Tyr
  MISC_FEATURE (108)..(108): Xaa is any amino acid but Cys, Arg, or Pro
  VARIANT (109)..(141): positions 109 to 141 may be absent
  MISC_FEATURE (110)..(111): Xaa is any amino acid but Cys, Arg, or Pro
  MISC_FEATURE (113)..(113): Xaa is any amino acid but Cys, Arg, or Pro
  MISC_FEATURE (121)..(122): Xaa is any amino acid but Cys, Arg, or Pro
  MISC_FEATURE (134)..(134): Xaa is His, Asn, or Tyr
  MISC_FEATURE (141)..(141): Xaa is any amino acid but Cys, Arg, or Pro
MRGSHHHHHHGSDLGKKLLEAARAGQDDEVRILMANGADVNADXXGXTPLHLAAXXGHLEIVEVLLKXGADVNAXDXXGXTPLHLAAXXGHLEIVEVLLKXGADVNAXDXXGXTPLHLAAXXGHLEIVEVLLKXGADVNAXQDKFGKTAFDISIDNGNEDLAEILQ

SEQ ID NO: 32 - protein, 25 aa, Artificial sequence
  artificial construct
QDKFGKTAFDISIDNGNEDLAEILQ

SEQ ID NO: 33 - protein, 28 aa, Artificial sequence
  artificial construct
  MISC_FEATURE (3)..(3): Xaa is any amino acid
  MISC_FEATURE (5)..(5): Xaa is any amino acid
  MISC_FEATURE (8)..(8): Xaa is any amino acid
  MISC_FEATURE (12)..(13): Xaa is any amino acid
  MISC_FEATURE (15)..(15): Xaa is any amino acid
  MISC_FEATURE (19)..(19): Xaa is any amino acid
  MISC_FEATURE (25)..(25): Xaa is any amino acid
EFXCXNGXCIPXXWXCDGXDDCGDXSDE

SEQ ID NO: 34 - protein, 74 aa, Artificial sequence
  artificial construct
  MISC_FEATURE (12)..(22): Xaa is any amino acid
  MISC_FEATURE (13)..(21): Xaa may be absent
  MISC_FEATURE (41)..(48): Xaa is any amino acid
  MISC_FEATURE (42)..(46): Xaa may be absent
  MISC_FEATURE (61)..(61): Xaa is any amino acid
GVTLFVALYDYXXXXXXXXXXXLSFHKGEKFQILSTHEYEXXXXXXXXWEARSLTTGETGXIPSNYVAPVDSIQ

SEQ ID NO: 35 - protein, 68 aa, Artificial sequence
  artificial construct
  MISC_FEATURE (12)..(22): Xaa is any amino acid
  MISC_FEATURE (16)..(21): Xaa is optionally absent
GVTLFVALYDYXXXXXXXXXXXLSFHKGEKFQILSTHEYEDWWEARSLTTGETGYIPSNYVAPVDSIQ

SEQ ID NO: 36 - protein, 60 aa, Artificial sequence
  artificial construct
  MISC_FEATURE (11)..(11): Xaa is one of: Ala, Asp, Glu, Phe, Gly, His, Ile, Lys, Leu, Met, Asn, Pro, Gln, Arg, Ser, Thr, Val, Trp, Tyr
  MISC_FEATURE (13)..(13): Xaa is one of: Ala, Asp, Glu, Phe, Gly, His, Ile, Lys, Leu, Met, Asn, Pro, Gln, Arg, Ser, Thr, Val, Trp, Tyr
  MISC_FEATURE (15)..(15): Xaa is one of: Ala, Asp, Glu, Phe, Gly, His, Ile, Lys, Leu, Met, Asn, Gln, Arg, Ser, Thr, Val, Trp, Tyr
  MISC_FEATURE (16)..(16): Xaa is one of: Ala, Gly, Glu, Asp, His, Thr
  MISC_FEATURE (17)..(17): Xaa is one of: Ala, Asp, Glu, Phe, Gly, His, Ile, Lys, Leu, Met, Asn, Gln, Arg, Ser, Thr, Val, Trp, Tyr
  MISC_FEATURE (18)..(18): Xaa is one of: Ala, Asp, Glu, Phe, Gly, His, Ile, Lys, Leu, Met, Asn, Gln, Arg, Ser, Thr, Val, Trp, Tyr
  MISC_FEATURE (19)..(19): Xaa is one of: Ala, Asp, Glu, Phe, Gly, His, Ile, Lys, Leu, Met, Asn, Pro, Gln, Arg, Ser, Thr, Val, Trp, Tyr
  MISC_FEATURE (34)..(34): Xaa is one of: Ala, Cys, Asp, Glu, Phe, Gly, His, Ile, Lys, Leu, Met, Asn, Pro, Gln, Arg, Ser, Thr, Val, Trp, Tyr
  MISC_FEATURE (39)..(39): Xaa is one of: Ala, Cys, Asp, Glu, Phe, Gly, His, Ile, Lys, Leu, Met, Asn, Pro, Gln, Arg, Ser, Thr, Val, Trp, Tyr
  MISC_FEATURE (40)..(40): Xaa is one of: Gly, and Ala
MHSFCAFKADXGXCXXXXXRFFFNIFTRQCEEFXYGGCXXNQNRFESLEECKKMCTRDGA

SEQ ID NO: 37 - protein, 32 aa, Artificial sequence
  artificial construct
  MISC_FEATURE (7)..(7): Xaa is any amino acid
  MISC_FEATURE (9)..(9): Xaa is any amino acid
  MISC_FEATURE (12)..(14): Xaa is any amino acid
  MISC_FEATURE (14)..(14): Xaa is optionally absent
  MISC_FEATURE (18)..(18): Xaa is any amino acid
  MISC_FEATURE (20)..(20): Xaa is any amino acid
  MISC_FEATURE (22)..(22): Xaa is any amino acid
  MISC_FEATURE (25)..(25): Xaa is any amino acid
  MISC_FEATURE (27)..(27): Xaa is any amino acid
KLPPGWXKXWSXXXGRVXYXNXITXAXQWERP

SEQ ID NO: 38 - protein, 31 aa, Artificial sequence
  artificial construct
  MISC_FEATURE (7)..(7): Xaa is any amino acid
  MISC_FEATURE (9)..(9): Xaa is any amino acid
  MISC_FEATURE (12)..(13): Xaa is any amino acid
  MISC_FEATURE (14)..(14): Xaa is Gly that is optionally absent
  MISC_FEATURE (17)..(17): Xaa is any amino acid
  MISC_FEATURE (19)..(19): Xaa is any amino acid
  MISC_FEATURE (21)..(21): Xaa is any amino acid
  MISC_FEATURE (24)..(24): Xaa is any amino acid
  MISC_FEATURE (26)..(26): Xaa is any amino acid
KLPPGWXKXWSXXXRVXYXNXITXAXQWERP

SEQ ID NO: 39 - protein, 10 aa, Artificial sequence
  artificial construct
GGGGTGGGGS

SEQ ID NO: 40 - protein, 10 aa, Artificial sequence
  artificial construct
GGGGDGGGGS

SEQ ID NO: 41 - protein, 668 aa, Homo sapiens
DSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 42 - protein, 630 aa, Homo sapiens
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLT

SEQ ID NO: 43 - protein, 5 aa, Artificial sequence
  artificial construct
GGGGS

SEQ ID NO: 44 - protein, 73 aa, Artificial sequence
  artificial construct
MGSWYEFSWRLQAIHQRLNALGGSEAELAAFEKEIAAFESELQAYKGKGNPEVEELRAYAAGIRGALQAYRHN

SEQ ID NO: 45 - protein, 73 aa, Artificial sequence
  artificial construct
MGSWHEFTWRLIAIQQRLEALGGSEAELAAFEKEIAAFESELQAYKGKGNPEVEELRAYAAGIRHHLQAYRHN

SEQ ID NO: 46 - protein, 73 aa, Artificial sequence
  artificial construct
MGSWREFAWRLVAINSRLKALGGSEAELAAFEKEIAAFESELQAYKGKGNPEVEELRHYAASIRDGLQAYRHN

SEQ ID NO: 47 - protein, 73 aa, Artificial sequence
  artificial construct
MGSWHEFAWRLQAINQRLNALGGSEAELAAFEKEIAAFESELQAYKGKGNPEVEELRHYAAHIRNGLQAYRHN

SEQ ID NO: 48 - protein, 73 aa, Artificial sequence
  artificial construct
MGSWNEFAWRLTAIEQRLMALGGSEAELAAFEKEIAAFESELQAYKGKGNPEVEELRHYAAGIRDNLQAYRHN

SEQ ID NO: 49 - protein, 73 aa, Artificial sequence
  artificial construct
MGSWTEFAWRLQAIHQRLQALGGSEAELAAFEKEIAAFESELQAYKGKGNPEVEELRVYAAKIRISLQAYRHN

SEQ ID NO: 50 - protein, 73 aa, Artificial sequence
  artificial construct
MGSWIEFAWRLQAIHQRLDALGGSEAELAAFEKEIAAFESELQAYKGKGNPEVEDLREYAANIRDSLQAYRHN

SEQ ID NO: 51 - protein, 73 aa, Artificial sequence
  artificial construct
MGSWHEFTWRLVAIQQRLQALGGSEAELAAFEKEIAAFESELQAYKGKGNPEVEELRKFAAKIRYELQAYRHN

SEQ ID NO: 52 - protein, 73 aa, Artificial sequence
  artificial construct
MGSWHEFTWRLIAIRERLFALGGSEAELAAFEKEIAAFESELQAYKGKGNPEVEELREYAASIRNMLQAYRHN

SEQ ID NO: 53 - protein, 73 aa, Artificial sequence
  artificial construct
MGSWIEFSWRLEAIRQRLQALGGSEAELAAFEKEIAAFESELQAYKGKGNPEVESLRSYAARIRQELQAYRHN

SEQ ID NO: 54 - protein, 73 aa, Artificial sequence
  artificial construct
MGSWVEFSWRLEAIRQRLQALGGSEAELAAFEKEIAAFESELQAYKGKGNPEVESLRSYAARIRQELQAYRHN

SEQ ID NO: 55 - protein, 73 aa, Artificial sequence
  artificial construct
MGSWVEFSWRLEAIRQRLTALGGSEAELAAFEKEIAAFESELQAYKGKGNPEVEDLRKYAARIRGELQAYRHN

SEQ ID NO: 56 - protein, 73 aa, Artificial sequence
  artificial construct
MGSWVEFAWRLTAIDQRLSALGGSEAELAAFEKEIAAFESELQAYKGKGNPEVENLRFYAAKIRSHLQAYRHN

SEQ ID NO: 57 - protein, 73 aa, Artificial sequence
  artificial construct
MGSWVEFAWRLEAIKQRLTALGGSEAELAAFEKEIAAFESELQAYKGKGNPEVEELRLYAAKIRRVLQAYRHN

SEQ ID NO: 58 - protein, 73 aa, Artificial sequence
  artificial construct
MGSWVEFAWRLTAIHTRLWALGGSEAELAAFEKEIAAFESELQAYKGKGNPEVESLRKYAAKIRKQLQAYRHN

SEQ ID NO: 59 - protein, 73 aa, Artificial sequence
  artificial construct
MGSWTEFAWRLEAINQRLQALGGSEAELAAFEKEIAAFESELQAYKGKGKPEVEALRAYAAKIRTRLQAYRHN

SEQ ID NO: 60 - protein, 73 aa, Artificial sequence
  artificial construct
MGSWSEFAWRLEAIHQRLSALGGSEAELAAFEKEIAAFESELQAYKGKGNPEVESLRLFAAQIRENLQAYRHN

SEQ ID NO: 61 - protein, 73 aa, Artificial sequence
  artificial construct
MGSWNEFAWRLIAINQRLWALGGSEAELAAFEKEIAAFESELQAYKGKGNPEVESLRHFAANIRNDLQAYRHN

SEQ ID NO: 62 - protein, 73 aa, Artificial sequence
  artificial construct
MGSWTEFAWRLIAIDQRLMALGGSEAELAAFEKEIAAFESELQAYKGKGNPEVEILRELAAEIRFHLQAYRHN

SEQ ID NO: 63 - protein, 73 aa, Artificial sequence
  artificial construct
MGSWSEFMNRLDAITYRLVALGGSEAELAAFEKEIAAFESELQAYKGKGNPEVELLRHYAAQIRDSLQAYRHN

SEQ ID NO: 64 - protein, 73 aa, Artificial sequence
  artificial construct
MGSWTEFMERLDAISYRLWALGGSEAELAAFEKEIAAFESELQAYKGKGNPEVEVLRDYAAIIRNSLQAYRHN

SEQ ID NO: 65 - protein, 73 aa, Artificial sequence
  artificial construct
MGSWAEFMDRLDAITYRLWALGGSEAELAAFEKEIAAFESELQAYKGKGNPEVEELRGYAAIIRSELQAYRHN

SEQ ID NO: 66 - protein, 73 aa, Artificial sequence
  artificial construct
MGSWIEFQERLDAIFYRLHALGGSEAELAAFEKEIAAFESELQAYKGKGNPEVEDLRDAAATIRRQLQAYRHN

SEQ ID NO: 67 - protein, 73 aa, Artificial sequence
  artificial construct
MGSWIEFQQRLDAIFYRLYALGGSEAELAAFEKEIAAFESELQAYKGKGNPEVENLRDMAAIIRKQLQAYRHN

SEQ ID NO: 68 - protein, 73 aa, Artificial sequence
  artificial construct
MGSWYEFQSRLDAIFYRLFALGGSEAELAAFEKEIAAFESELQAYKGKGNPEVEKLREAAASIRTQLQAYRHN

SEQ ID NO: 69 - protein, 73 aa, Artificial sequence
  artificial construct
MGSWSEFIDRLDAITYRLFALGGSEAELAAFEKEIAAFESELQAYKGKGNPEVENLRWYAGVIREQLQAYRHN

SEQ ID NO: 70 - protein, 73 aa, Artificial sequence
  artificial construct
MGSWSEFYDRLYAINQRLFALGGSEAELAAFEKEIAAFESELQAYKGKGNPEVEDLRWYAAFIRAQLQAYRHN

SEQ ID NO: 71 - protein, 73 aa, Artificial sequence
  artificial construct
MGSWYEFYDRLDAIVHRLDALGGSEAELAAFEKEIAAFESELQAYKGKGNPEVENLRWYAAMIRVRLQAYRHN

SEQ ID NO: 72 - protein, 73 aa, Artificial sequence
  artificial construct
MGSWVEFQDRLEAITDRLYALGGSEAELAAFEKEIAAFESELQAYKGKGNPEVEELRYSAAMIRVILQAYRHN

SEQ ID NO: 73 - protein, 73 aa, Artificial sequence
  artificial construct
MGSWVEFQERLMAISDRLYALGGSEAELAAFEKEIAAFESELQAYKGKGNPEVEELRWQAAMIRYTLQAYRHN

SEQ ID NO: 74 - protein, 73 aa, Artificial sequence
  artificial construct
MGSWFEFQHRLEAISMRLHALGGSEAELAAFEKEIAAFESELQAYKGKGNPEVEELRWQAAYIRVVLQAYRHN

SEQ ID NO: 75 - protein, 73 aa, Artificial sequence
  artificial construct
MGSWVEFQSRLEAIATRLRALGGSEAELAAFEKEIAAFESELQAYKGKGNPEVEELRWQAAWIRMMLQAYRHN

SEQ ID NO: 76 - protein, 73 aa, Artificial sequence
  artificial construct
MGSWEEFQYRLGAIAARLQALGGSEAELAAFEKEIAAFESELQAYKGKGNPEVEELRWQAAMIRFMLQAYRHN

SEQ ID NO: 77 - protein, 73 aa, Artificial sequence
  artificial construct
MGSWYEFQVRLQAISWRLKALGGSEAELAAFEKEIAAFESELQAYKGKGNHEVEELRIQAALIRVMLQAYRHN

SEQ ID NO: 78 - protein, 73 aa, Artificial sequence
  artificial construct
MGSWVEFRSRLEAISNRLRALGGSEAELAAFEKEIAAFESELQAYKGKGNPEVEELRTTAALIRVYLQAYRHN

SEQ ID NO: 79 - protein, 73 aa, Artificial sequence
  artificial construct
MGSWVEFKARLEAISSRLTALGGSEAELAAFEKEIAAFESELQAYKGKGNPEVEELRYSAALIRVYLQAYRHN

SEQ ID NO: 80 - protein, 73 aa, Artificial sequence
  artificial construct
MGSWSEFYTRLEAINNRLHALGGSEAELAAFEKEIAAFESELQAYKGKGNPEVEELRYTAALIRIYLQAYRHN

SEQ ID NO: 81 - protein, 73 aa, Artificial sequence
  artificial construct
MGSWAEFYHRLDAISSRLRALGGSEAELAAFEKEIAAFESELQAYKGKGNPEVEELRYTAALIRIYLQAYRHN

SEQ ID NO: 82 - protein, 73 aa, Artificial sequence
  artificial construct
MGSWTEFASRLVAIRQRLQALGGSEAELAAFEKEIAAFESELQAYKGKGNPEVEELRYSAAIIRVMLQAYRHN

SEQ ID NO: 83 - protein, 73 aa, Artificial sequence
  artificial construct
MGSWSEFDQRLAAIYQRLNALGGSEAELAAFEKEIAAFESELQAYKGKGNPEVEELRYSAALIRVMLQAYRHN

SEQ ID NO: 84 - protein, 73 aa, Artificial sequence
  artificial construct
MGSWVEFHNRLSAISDRLGALGGSEAELAAFEKEIAAFESELQAYKGKGNPEVEELRYSAALIRVMLQAYRHN

SEQ ID NO: 85 - protein, 73 aa, Artificial sequence
  artificial construct
MGSWNEFEDRLSAISARLSALGGSEAELAAFEKEIAAFESELQAYKGKGNPEVEELRYSAALIRVMLQAYRHN

SEQ ID NO: 86 - protein, 73 aa, Artificial sequence
  artificial construct
MGSWVEFEYRLVAIFDRLQALGGSEAELAAFEKEIAAFESELQAYKGKGNPEVEELRYQAALIRVMLQAYRHN

SEQ ID NO: 87 - protein, 73 aa, Artificial sequence
  artificial construct
MGSWVEFQGRLGAIHERLQALGGSEAELAAFEKEIAAFESELQAYKGKGNPEVEELRYSAALIRVFLQAYRHN

SEQ ID NO: 88 - protein, 73 aa, Artificial sequence
  artificial construct
MGSWYEFSMRLSAIWERLHALGGSEAELAAFEKEIAAFESELQAYKGKGNPEVEELRYQAALIRFYLQAYRHN

SEQ ID NO: 89 - protein, 73 aa, Artificial sequence
  artificial construct
MGSWTEFSQRLGAISERLYALGGSEAELAAFEKEIAAFESELQAYKGKGNPEVEELRYSAALIRFMLQAYRHN

SEQ ID NO: 90 - protein, 73 aa, Artificial sequence
  artificial construct
MGSWTEFHDRLEAITHRLNALGGSEAELAAFEKEIAAFESELQAYKGKGNPEVEELRYSAALLRVFLQAYRHN

SEQ ID NO: 91 - protein, 73 aa, Artificial sequence
  artificial construct
MGSWTEFEHRLEAIAGRLNALGGSEAELAAFEKEIAAFESELQAYKGKGNPEVEELRYSAALIRFWLQAYRHN

SEQ ID NO: 92 - protein, 73 aa, Artificial sequence
  artificial construct
MGSWTEFANRLEAINARLHALGGSEAELAAFEKEIAAFESELQAYKGKGNPEVEELRFSAALIRVYLQAYRHN

SEQ ID NO: 93 - protein, 73 aa, Artificial sequence
  artificial construct
MGSWEEFDRRLYAIARRLEALGGSEAELAAFEKEIAAFESELQAYKGKGNPEVEELRYQAALIRVWLQAYRHN

SEQ ID NO: 94 - protein, 73 aa, Artificial sequence
  artificial construct
MGSWIEFHQRLEAIVTRLEALGGSEAELAAFEKEIAAFESELQAYKGKGNPEVEELRYQAALIRVFLQAYRHN

SEQ ID NO: 95 - protein, 73 aa, Artificial sequence
  artificial construct
MGSWSEFYDRLKAIADRLHALGGSEAELAAFEKEIAAFESELQAYKGKGNPEVEELRTEAAIIRVYLQAYRHN

SEQ ID NO: 96 - protein, 73 aa, Artificial sequence
  artificial construct
MGSWWEFEDRLSAIMERLHALGGSEAELAAFEKEIAAFESELQAYKGKGNPEVEELRYRAAIIRVYLQAYRHN

SEQ ID NO: 97 - protein, 73 aa, Artificial sequence
  artificial construct
MGSWVEFEERLAAIATRLHALGGSEAELAAFEKEIAAFESELQAYKGKGNPEVEELRWRAAIIRVYLQAYRHN

SEQ ID NO: 98 - protein, 73 aa, Artificial sequence
  artificial construct
MGSWSEFRGRLQAIHSRLNALGGSEAELAAFEKEIAAFESELQAYKGKGNPEVEELRYSAAIIRIYLQAYRHN

SEQ ID NO: 99 - protein, 73 aa, Artificial sequence
  artificial construct
MGSWTEFRDRLGAIYHRLDALGGSEAELAAFEKEIAAFESELQAYKGKGNPEVEELRYQAAIIRVYLQAYRHN

SEQ ID NO: 100 - protein, 73 aa, Artificial sequence
  artificial construct
MGSWVEFYHRLEAIRYRLSALGGSEAELAAFEKEIAAFESELQAYKGKGNPEVEELRYVAAVIRYRLQAYRHN

SEQ ID NO: 101 - protein, 73 aa, Artificial sequence
  artificial construct
MGSWVEFYDRLEAIRYRLSALGGSEAELAAFEKEIAAFESELQAYKGKGNPEVEELRYIAAVIRYRLQAYRHN

SEQ ID NO: 102 - protein, 73 aa, Artificial sequence
  artificial construct
MGSWVEFYDRLAAIRKRLYALGGSEAELAAFEKEIAAFESELQAYKGKGNPEVEELRFRAALIRIWLQAYRHN

SEQ ID NO: 103 - protein, 73 aa, Artificial sequence
  artificial construct
MGSWEEFSERLEAISIRLRALGGSEAELAAFEKEIAAFESELQAYKGKGNPEVEELRVSAAIIRVWLQAYRHN

SEQ ID NO: 104 - protein, 73 aa, Artificial sequence
  artificial construct
MGSWSEFSDRLHAISDRLQALGGSEAELAAFEKEIAAFESELQAYKGKGNPEVEELRIQAAIIRVWLQAYRHN

SEQ ID NO: 105 - protein, 73 aa, Artificial sequence
  artificial construct
MGSWIEFSHRLEAIVDRLGALGGSEAELAAFEKEIAAFESELQAYKGKGNPEVEELRNTAAIIRVYLQAYRHN

SEQ ID NO: 106 - protein, 73 aa, Artificial sequence
  artificial construct
MGSWEEFSDRLEAILRRLDALGGSEAELAAFEKEIAAFESELQAYKGKGNPEVEDLRFAAAIIRVQLQAYRHN

SEQ ID NO: 107 - protein, 73 aa, Artificial sequence
  artificial construct
MGSWMEFSHRLDAIHERLYALGGSEAELAAFEKEIAAFESELQAYKGKGNPEVEDLRFAAAIIRVQLQAYRHN

SEQ ID NO: 108 - protein, 73 aa, Artificial sequence
  artificial construct
MGSWSEFQQRLHAIRTRLYALGGSEAELAAFEKEIAAFESELQAYKGKGNPEVEELRFEAAIIRVMLQAYRHN

SEQ ID NO: 109 - protein, 73 aa, Artificial sequence
  artificial construct
MGSWYEFQNRLGAINRRLNALGGSEAELAAFEKEIAAFESELQAYKGKGNPEVEELRFEAAIIRVMLQAYRHN

SEQ ID NO: 110 - protein, 73 aa, Artificial sequence
  artificial construct
MGSWQEFTGRLHAIRHRLEALGGSEAELAAFEKEIAAFESELQAYKGKGNPEVEELRFEAAYIRVWLQAYRHN

SEQ ID NO: 111 - protein, 73 aa, Artificial sequence
  artificial construct
MGSWTEFDHRLGAIWERLVALGGSEAELAAFEKEIAAFESELQAYKGKGNPEVEELRFHAAIIRIFLQAYRHN

SEQ ID NO: 112 - protein, 73 aa, Artificial sequence
  artificial construct
MGSWTEFHVRLSAIWDRLVALGGSEAELAAFEKEIAAFESELQAYKGKGNPEVEELRFHAAIIRIVLQAYRHN

SEQ ID NO: 113 - protein, 73 aa, Artificial sequence
  artificial construct
MGSWNEFDNRLQAIWDRLHALGGSEAELAAFEKEIAAFESELQAYKGKGNPEVEELRFHAAMIRITLQAYRHN

SEQ ID NO: 114 - protein, 73 aa, Artificial sequence
  artificial construct
MGSWTEFHERLQAIWFRLHALGGSEAELAAFEKEIAAFESELQAYKGKGNPEVEELRFRAAIIRLYLQAYRHN

SEQ ID NO: 115 - protein, 73 aa, Artificial sequence
  artificial construct
MGSWNEFSGRLTAIKDRLAALGGSEAELAAFEKEIAAFESELQAYKGKGNPEVEELRFRAAVIRLWLQAYRHN

SEQ ID NO: 116 - protein, 73 aa, Artificial sequence
  artificial construct
MGSWVEFDERLVAIWFRLHALGGSEAELAAFEKEIAAFESELQAYKGKGNPEVEALRARAAYIRIWLQAYRHN

SEQ ID NO: 117 - protein, 73 aa, Artificial sequence
  artificial construct
MGSWSEFGQRLSAIWERLLALGGSEAELAAFEKEIAAFESELQAYKGKGNPEVEALRADAAFIRIWLQAYRHN

SEQ ID NO: 118 - protein, 73 aa, Artificial sequence
  artificial construct
MGSWYEFEDRLVAIWIRLDALGGSEAELAAFEKEIAAFESELQAYKGKGNPEVEELRYNAAFIRGALQAYRHN

SEQ ID NO: 119 - protein, 73 aa, Artificial sequence
  artificial construct
MGSWYEFGDRLSAIWERLAALGGSEAELAAFEKEIAAFESELQAYKGKGNPEVEYLRTHAAEIRTILQAYRHN

SEQ ID NO: 120 - protein, 73 aa, Artificial sequence
  artificial construct
MGSWHEFYYRLEAIEQRLHALGGSEAELAAFEKEIAAFESELQAYKGKGNPEVETLRFDAALIRIYLQAYRHN

SEQ ID NO: 121 - protein, 73 aa, Artificial sequence
  artificial construct
MGSWSEFEERLAAIGSRLFALGGSEAELAAFEKEIAAFESELQAYKGKGNPEVETLRFDAALIRIYLQAYRHN

SEQ ID NO: 122 - protein, 73 aa, Artificial sequence
  artificial construct
MGSWLEFHYRLHAIQFRLYALGGSEAELAAFEKEIAAFESELQAYKGKGNPEVETLRHIAALIRNQLQAYRHN

SEQ ID NO: 123 - protein, 73 aa, Artificial sequence
  artificial construct
MGSWQEFYNRLEAIHMRLFALGGSEAELAAFEKEIAAFESELQAYKGKGNPEVEGLRSDAAPIRDVLQAYRHN

SEQ ID NO: 124 - protein, 73 aa, Artificial sequence
  artificial construct
MGSWNEFHHRLWAIFDRLGALGGSEAELAAFEKEIAAFESELQAYKGKGNPEVEVLRKMAAGIRGGLQAYRHN

SEQ ID NO: 125 - protein, 73 aa, Artificial sequence
  artificial construct
MGSWYEFHYRLKAINDRLYALGGSEAELAAFEKEIAAFESELQAYKGKGNPEVEYLRYSAAMIRHKLQAYRHN

SEQ ID NO: 126 - protein, 73 aa, Artificial sequence
  artificial construct
MGSWTEFHQRLGAIHARLGALGGSEAELAAFEKEIAAFESELQAYKGKGNPEVEYLRFSAAFIRLKLQAYRHN

SEQ ID NO: 127 - protein, 73 aa, Artificial sequence
  artificial construct
MGSWFEFQYRLEAIFYRLLALGGSEAELAAFEKEIAAFESELQAYKGKGKPEVEELRVRAALIRHLLQAYRHN

SEQ ID NO: 128 - protein, 73 aa, Artificial sequence
  artificial construct
MGSWVEFHARLDAIYTRLGALGGSEAELAAFEKEIAAFESELQAYKGKGNPEVEYLRVLAAHIRISLQAYRHN

SEQ ID NO: 129 - protein, 73 aa, Artificial sequence
  artificial construct
MGSWVEFGTRLSAIYNRLWALGGSEAELAAFEKEIAAFESELQAYKGKGNPEVEDLRFEAAIIRIMLQAYRHN

SEQ ID NO: 130 - protein, 73 aa, Artificial sequence
  artificial construct
MGSWVEFTHRLDAIYIRLWALGGSEAELAAFEKEIAAFESELQAYKGKGNPEVEELRHEAAVIREELQAYRHN

SEQ ID NO: 131 - protein, 73 aa, Artificial sequence
  artificial construct
MGSWVEFHGRLAAIYVRLFALGGSEAELAAFEKEIAAFESELQAYKGKGNPEVESLRYHAAMIRRNLQAYRHN

SEQ ID NO: 132 - protein, 73 aa, Artificial sequence
  artificial construct
MGSWVEFDRRLVAIYIRLWALGGSEAELAAFEKEIAAFESELQAYKGKGNPEVEALRDDAALIRLLLQAYRHN

SEQ ID NO: 133 - protein, 73 aa, Artificial sequence
  artificial construct
MGSWVEFDRRLVAIYIRLWALGGSEAELAAFEKEIAAFESELQAYKGKGNPEVEKLRYDAATIRETLQAYRHN

SEQ ID NO: 134 - protein, 73 aa, Artificial sequence
  artificial construct
MGSWLEFDRRLTAIYLRLWALGGSEAELAAFEKEIAAFESELQAYKGKGNPEVEALREDAAMIRDMLQAYRHN

SEQ ID NO: 135 - protein, 73 aa, Artificial sequence
  artificial construct
MGSWIEFDRRLLAIHVRLWALGGSEAELAAFEKEIAAFESELQAYKGKGNPEVEVLRADAAKIRMELQAYRHN

SEQ ID NO: 136 - protein, 73 aa, Artificial sequence
  artificial construct
MGSWIEFDRRLIAIWIRLWALGGSEAELAAFEKEIAAFESELQAYKGKGNPEVESLRSDAADIRQKLQAYRHN

SEQ ID NO: 137 - protein, 73 aa, Artificial sequence
  artificial construct
MGSWVEFDRRLIAIWVRLWALGGSEAELAAFEKEIAAFESELQAYKGKGNPEVEFLRSDAAMIREHLQAYRHN

SEQ ID NO: 138 - protein, 73 aa, Artificial sequence
  artificial construct
MGSWYEFHTRLIAIYVRLWALGGSEAELAAFEKEIAAFESELQAYKGKGNPEVEWLRGDAAKIRGYLQAYRHN

SEQ ID NO: 139 - protein, 73 aa, Artificial sequence
  artificial construct
MGSWSEFSTRLSAIYVRLWALGGSEAELAAFEKEIAAFESELQAYKGKGNPEVEYLRNKAASIRKTLQAYRHN

SEQ ID NO: 140 - protein, 73 aa, Artificial sequence
  artificial construct
MGSWVEFRYRLGAIYHRLWALGGSEAELAAFEKEIAAFESELQAYKGKGNPEVEVLRDRAATIRRLLQAYRHN

SEQ ID NO: 141 - protein, 73 aa, Artificial sequence
  artificial construct
MGSWNEFRNRLGAIDSRLWALGGSEAELAAFEKEIAAFESELQAYKGKGNPEVETLRAHAAIIRSVLQAYRHN

SEQ ID NO: 142 - protein, 73 aa, Artificial sequence
  artificial construct
MGSWHEFRNRLGAIDSRLWALGGSEAELAAFEKEIAAFESELQAYKGKGNPEVETLRARAAMIRSVLQAYRHN

SEQ ID NO: 143 - protein, 73 aa, Artificial sequence
  artificial construct
MGSWTEFYQRLEAINFRLWALGGSEAELAAFEKEIAAFESELQAYKGKGNPEVEVLRDKAALIRLMLQAYRHN

SEQ ID NO: 144 - protein, 73 aa, Artificial sequence
  artificial construct
MGSWNEFYNRLHAINLRLWALGGSEAELAAFEKEIAAFESELQAYKGKGNPEVEVLREHAAIIRQALQAYRHN

SEQ ID NO: 145 - protein, 73 aa, Artificial sequence
  artificial construct
MGSWEEFYGRLSAIQDRLWALGGSEAELAAFEKEIAAFESELQAYKGKGNPEVEWLRMHAAVIRRALQAYRHN

SEQ ID NO: 146 - protein, 73 aa, Artificial sequence
  artificial construct
MGSWGEFNLRLVAIHVRLWALGGSEAELAAFEKEIAAFESELQAYKGKGNPEVEFLRSQAANIRAQLQAYRHN

SEQ ID NO: 147 - protein, 73 aa, Artificial sequence
  artificial construct
MGSWGEFSDRLEAINERLWALGGSEAELAAFEKEIAAFESELQAYKGKGNPEVEELRWQAAFIRANLQAYRHN

SEQ ID NO: 148 - protein, 73 aa, Artificial sequence
  artificial construct
MGSWMEFQGRLPAILARLRALGGSEAELAAFEKEIAAFESELQAYKGKGNPEVEHLRDKAAYIRWMLQAYRHN

SEQ ID NO: 149 - protein, 73 aa, Artificial sequence
  artificial construct
MGSWMEFEGRLPAILARLRALGGSEAELAAFEKEIAAFESELQAYKGKGNPEVEHLRDKAAYIRWMLQAYRHN

SEQ ID NO: 150 - protein, 73 aa, Artificial sequence
  artificial construct
MGSWFEFQNRLQAILFRLRALGGSEAELAAFEKEIAAFESELQAYKGKGNPEVENLRDKAAYIRLMLQAYRHN

SEQ ID NO: 151 - protein, 73 aa, Artificial sequence
  artificial construct
MGSWVEFDMRLQAILERLRALGGSEAELAAFEKEIAAFESELQAYKGKGNPEVEHLRDSAAYIRLMLQAYRHN

SEQ ID NO: 152 - protein, 73 aa, Artificial sequence
  artificial construct
MGSWVEFNARLDAILFRLRALGGSEAELAAFEKEIAAFESELQAYKGKGNPEVEHLRDQAAYIRLMLQAYRHN

SEQ ID NO: 153 - protein, 73 aa, Artificial sequence
  artificial construct
MGSWMEFNVRLRAILDRLHALGGSEAELAAFEKEIAAFESELQAYKGKGNPEVELLRDKAAYIRFMLQAYRHN

SEQ ID NO: 154 - protein, 73 aa, Artificial sequence
  artificial construct
MGSWIEFDTRLAAIVHRLRALGGSEAELAAFEKEIAAFESELQAYKGKGNPEVELLRDKAAYIRYMLQAYRHN

SEQ ID NO: 155 - protein, 73 aa, Artificial sequence
  artificial construct
MGSWIEFDYRLKAILHRLRALGGSEAELAAFEKEIAAFESELQAYKGKGNPEVEGLRDKAAYIRFLLQAYRHN

SEQ ID NO: 156 - protein, 73 aa, Artificial sequence
  artificial construct
MGSWYEFEDRLLAIKVRLRALGGSEAELAAFEKEIAAFESELQAYKGKGNPEVEYLRDQAAYIRFMLQAYRHN

SEQ ID NO: 157 - protein, 73 aa, Artificial sequence
  artificial construct
MGSWYEFQDRLSAITTRLRALGGSEAELAAFEKEIAAFESELQAYKGKGNPEVELLRDKAAYIRFMLQAYRHN

SEQ ID NO: 158 - protein, 73 aa, Artificial sequence
  artificial construct
MGSWEEFDDRLNAIVYRLRALGGSEAELAAFEKEIAAFESELQAYKGKGNPEVEMLRDQAAYIRLMLQAYRHN

SEQ ID NO: 159 - protein, 73 aa, Artificial sequence
  artificial construct
MGSWVEFEQRLHAIVVRLRALGGSEAELAAFEKEIAAFESELQAYKGGGNPEVENLRDQAAYIRFMLQAYRHN

SEQ ID NO: 160 - protein, 73 aa, Artificial sequence
  artificial construct
MGSWVEFEWRLEAIVVRLRALGGSEAELAAFEKEIAAFESELQAYKGKGNPEVEHLRDKAAYIRYMLQAYRHN

SEQ ID NO: 161 - protein, 73 aa, Artificial sequence
  artificial construct
MGSWYEFEHRLKAIVSRLGALGGSEAELAAFEKEIAAFESELQAYKGKGNPEVEHLRDKAAYIRYMLQAYRHN

SEQ ID NO: 162 - protein, 73 aa, Artificial sequence
  artificial construct
MGSWMEFKHRLAAITFRLRALGGSEAELAAFEKEIAAFESELQAYKGKGNPEVELLRDKAAYIRLLLQAYRHN

SEQ ID NO: 163 - protein, 73 aa, Artificial sequence
  artificial construct
MGSWMEFEGRLHAIKRRLRALGGSEAELAAFEKEIAAFESELQAYKGKGNPEVEVLRDQAAYIRLLLQAYRHN

SEQ ID NO: 164 - protein, 73 aa, Artificial sequence
  artificial construct
MGSWSEFVFRLDTIKSRLRALGGSEAELAAFEKEIAAFESELQAYKGKGNPEVETLRDQAAYIRLMLQAYRHN

SEQ ID NO: 165 - protein, 73 aa, Artificial sequence
  artificial construct
MGSWYEFDERLSAIKLRLRALGGSEAELAAFEKEIAAFESELQAYKGKGNPEVEVLRAQAAYIRAILQAYRHN

SEQ ID NO: 166 - protein, 73 aa, Artificial sequence
  artificial construct
MGSWMEFDERLWAIKKRLRALGGSEAELAAFEKEIAAFESELQAYKGKGNPEVEFLRHQAAYIRMLLQAYRHN

SEQ ID NO: 167 - protein, 73 aa, Artificial sequence
  artificial construct
MGSWHEFDGRLSAIKRRLWALGGSEAELAAFEKEIAAFESELQAYKGKGNPEVEHLRDQAAYIRYMLQAYRHN

SEQ ID NO: 168 - protein, 73 aa, Artificial sequence
  artificial construct
MGSWYEFDGRLQAIIARLRALGGSEAELAAFEKEIAAFESELQAYKGKGNPEVEHLRFRAAYIRWILQAYRHN

SEQ ID NO: 169 - protein, 73 aa, Artificial sequence
  artificial construct
MGSWFEFDKRLYAIIHRLRALGGSEAELAAFEKEIAAFESELQAYKGKGNPEVEKLRYKAAIIRLYLQAYRHN

SEQ ID NO: 170 - protein, 73 aa, Artificial sequence
  artificial construct
MGSWVEFDNRLYAIVDRLRALGGSEAELAAFEKEIAAFESELQAYKGKGNPEVEHLRQKAAYIRLILQAYRHN

SEQ ID NO: 171 - protein, 73 aa, Artificial sequence
  artificial construct
MGSWIEFHQRLNAIFNRLRALGGSEAELAAFEKEIAAFESELQAYKGKGNPEVEWLRHHAAYIREMLQAYRHN

SEQ ID NO: 172 - protein, 73 aa, Artificial sequence
  artificial construct
MGSWNEFRLRLWAITERLRALGGSEAELAAFEKEIAAFESELQAYKGKGNPEVECLRAEAAWIRTMLQAYRHN

SEQ ID NO: 173 - protein, 73 aa, Artificial sequence
  artificial construct
MGSWYEFWLRLSAISYRLQALGGSEAELAAFEKEIAAFESELQAYKGKGNPEVEWLRKEAAEIRSWLQAYRHN

SEQ ID NO: 174 - protein, 73 aa, Artificial sequence
  artificial construct
MGSWYEFQLRLWAIHWRLIALGGSEAELAAFEKEIAAFESELQAYKGKGNPEVEWLRMRAAEIRNELQAYRHN

SEQ ID NO: 175 - protein, 73 aa, Artificial sequence
  artificial construct
MGSWYEFAHRLEAIEWRLIALGGSEAELAAFEKEIAAFESELQAYKGKGNPEVEELRQYAAAIRNYLQAYRHN

SEQ ID NO: 176 - protein, 73 aa, Artificial sequence
  artificial construct
MGSWYEFDTRLGAIRNRLGALGGSEAELAAFEKEIAAFESELQAYKGKGNPEVEWLRFQAAYIRFLLQAYRHN

SEQ ID NO: 177 - protein, 73 aa, Artificial sequence
  artificial construct
MGSWYEFWVRLTAIRWRLEALGGSEAELAAFEKEIAAFESELQAYKGKGNPEVEWLREQAASIRWVLQAYRHN

SEQ ID NO: 178 - protein, 73 aa, Artificial sequence
  artificial construct
MGSWFEFDRRLKAIDRRLMALGGSEAELAAFEKEIAAFESELQAYKGKGNPEVEWLRMQAAIIRNYLQAYRHN

SEQ ID NO: 179 - protein, 73 aa, Artificial sequence
  artificial construct
MGSWVEFWERLDAIDNRLGALGGSEAELAAFEKEIAAFESELQAYKGKGNPEVEWLRWHAAYIRGYLQAYRHN

SEQ ID NO: 180 - protein, 73 aa, Artificial sequence
  artificial construct
MGSWAEFWDRLDAIDSRLNALGGSEAELAAFEKEIAAFESELQAYKGKGNPEVEYLREWAAYIRGYLQAYRHN

SEQ ID NO: 181 - protein, 73 aa, Artificial sequence
  artificial construct
MGSWAEFDLRLRAIAKRLVALGGSEAELAAFEKEIAAFESELQAYKGKGNPEVEMLRLDAAYIRGVLQAYRHN

SEQ ID NO: 182 - protein, 73 aa, Artificial sequence
  artificial construct
MGSWSEFWDRLYAIRIRLDALGGSEAELAAFEKEIAAFESELQAYKGKGNPEVEKLRSVAARIRNWLQAYRHN

SEQ ID NO: 183 - protein, 73 aa, Artificial sequence
  artificial construct
MGSWSEFWFRLGAIRNRLDALGGSEAELAAFEKEIAAFESELQAYKGKGNPEVEKLRDVAAHIRHWLQAYRHN

SEQ ID NO: 184 - protein, 73 aa, Artificial sequence
  artificial construct
MGSWSEFNDRLDAIRWRLDALGGSEAELAAFEKEIAAFESELQAYKGKGNPEVEWLRQVAATIRYRLQAYRHN

SEQ ID NO: 185 - protein, 73 aa, Artificial sequence
  artificial construct
MGSWVEFWDRLGAIRERLQALGGSEAELAAFEKEIAAFESELQAYKGKGNPEVEKLRYTAAAIRHYLQAYRHN

SEQ ID NO: 186 - protein, 73 aa, Artificial sequence
  artificial construct
MGSWAEFWDRLGAIRERLQALGGSEAELAAFEKEIAAFESELQAYKGKGNPEVEKLRYTAAAIRHYLQAYRHN

SEQ ID NO: 187 - protein, 73 aa, Artificial sequence
  artificial construct
MGSWTEFWDRLGAIRERLQALGGSEAELAAFEKEIAAFESELQAYKGKGNPEVEKLRYTAAAIRHYLQAYRHN

SEQ ID NO: 188 - protein, 73 aa, Artificial sequence
  artificial construct
MGSWVEFWDRLGAIRERLQALGGSEAELAAFEKEIAAFESELQAYKGKGNPEVEKLKYTAAAIRHYLQAYRHN

SEQ ID NO: 189 - protein, 73 aa, Artificial sequence
  artificial construct
MGSWVEFWDRLGAIRERLQALGGSEAELAAFEKEIAAFESELQAYKGKGNPEVEKLQYTAAAIRHYLQAYRHN

SEQ ID NO: 190 - protein, 73 aa, Artificial sequence
  artificial construct
MGSWVEFWDRLGAIRERLQALGGSEAELAAFEKEIAAFESELQAYKGKGNPEVEKLRYTAAAIKHYLQAYRHN

SEQ ID NO: 191 - protein, 73 aa, Artificial sequence
  artificial construct
MGSWAEFWDRLGAIRERLQALGGSEAELAAFEKEIAAFESELQAYKGKGNPEVEKLQYTAAAIKHYLQAYRHN

SEQ ID NO: 192 - protein, 73 aa, Artificial sequence
  artificial construct
MGSWTEFWDRLGAIRERLQALGGSEAELAAFEKEIAAFESELQAYKGKGNPEVEKLQYTAAAIKHYLQAYRHN

SEQ ID NO: 193 - protein, 73 aa, Artificial sequence
  artificial construct
MGSWVEFWDRLGAIRERLEALGGSEAELAAFEKEIAAFESELQAYKGKGNPEVEKLRYVAAVIRHRLQAYRHN

SEQ ID NO: 194 - protein, 73 aa, Artificial sequence
  artificial construct
MGSWVEFWDRLGAIRERLQALGGSEAELAAFEKEIAAFESELQAYKGKGNPEVEELRASAAAIRIALQAYRHN

SEQ ID NO: 195 - protein, 73 aa, Artificial sequence
  artificial construct
MGSWVEFWDRLGAIRDRLDALGGSEAELAAFEKEIAAFESELQAYKGKGNPEVEELRNTAAYIRTFLQAYRHN

SEQ ID NO: 196 - protein, 73 aa, Artificial sequence
  artificial construct
MGSWSEFWVRLGAIRDRLDALGGSEAELAAFEKEIAAFESELQAYKGKGNPEVEALRVTAAQIRHYLQAYRHN

SEQ ID NO: 197 - protein, 73 aa, Artificial sequence
  artificial construct
MGSWSEFWVRLGAIRERLDALGGSEAELAAFEKEIAAFESELQAYKGKGNPEVEKLRYTAATIRRFLQAYRHN

SEQ ID NO: 198 - protein, 73 aa, Artificial sequence
  artificial construct
MGSWSEFWARLGAIRERLDALGGSEAELAAFEKEIAAFESELQAYKGKGNPEVEKLRYTAATIRRFLQAYRHN

SEQ ID NO: 199 - protein, 73 aa, Artificial sequence
  artificial construct
MGSWSEFWVRLGAIRERLDALGGSEAELAAFEKEIAAFESELQAYKGKGNPEVEKLRYTAGTIRRFLQAYRHN

SEQ ID NO: 200 - protein, 73 aa, Artificial sequence
  artificial construct
MGSWSEFWVRLGAIRERLDALGGSEAELAAFEKEIAAFESELQAYKGKGNPEVEKLRYTAATIKRFLQAYRHN

SEQ ID NO: 201 - protein, 73 aa, Artificial sequence
  artificial construct
MGSWSEFWARLGAIRERLDALGGSEAELAAFEKEIAAFESELQAYKGKGNPEVEKLRYTAGTIKRFLQAYRHN

SEQ ID NO: 202 - protein, 73 aa, Artificial sequence
  artificial construct
MGSWSEFWDRLTAIRVRLDALGGSEAELAAFEKEIAAFESELQAYKGKGNPEVEKLRYTAAHIRKFLQAYRHN

SEQ ID NO: 203 - protein, 73 aa, Artificial sequence
  artificial construct
MGSWTEFWTRLNAIYERLDALGGSEAELAAFEKEIAAFESELQAYKGKGNPEVEKLRFTAASIRMYLQAYRHN

SEQ ID NO: 204 - protein, 73 aa, Artificial sequence
  artificial construct
MGSWFEFWDRLAAIRDRLEALGGSEAELAAFEKEIAAFESELQAYKGKGNPEVEDLRYVAAKIRVRLQAYRHN

SEQ ID NO: 205 - protein, 73 aa, Artificial sequence
  artificial construct
MGSWTEFWVRLNAIRDRLEALGGSEAELAAFEKEIAAFESELQAYKGKGNPEVEDLRHTAAIIRNYLQAYRHN

SEQ ID NO: 206 - protein, 73 aa, Artificial sequence
  artificial construct
MGSWVEFWHRLGAIYDRLEALGGSEAELAAFEKEIAAFESELQAYKGKGNPEVEELRRTAALIRQTLQAYRHN

SEQ ID NO: 207 - protein, 73 aa, Artificial sequence
  artificial construct
MGSWVEFWNRLGAIYDRLEALGGSEAELAAFEKEIAAFESELQAYKGKGNPEVEKLRHTAAVIRLYLQAYRHN

SEQ ID NO: 208 - protein, 73 aa, Artificial sequence
  artificial construct
MGSWSEFWERLEAIYDRLYALGGSEAELAAFEKEIAAFESELQAYKGKGNPEVEELRRTAATIRSFLQAYRHN

SEQ ID NO: 209 - protein, 73 aa, Artificial sequence
  artificial construct
MGSWEEFDNRLEAIFDRLEALGGSEAELAAFEKEIAAFESELQAYKGKGNPEVEELREFAATIRITLQAYRHN

SEQ ID NO: 210 - protein, 73 aa, Artificial sequence
  artificial construct
MGSWMEFWDRLYAIEFRLFALGGSEAELAAFEKEIAAFESELQAYKGKGNPEVEKLRRVAATIRNELQAYRHN

SEQ ID NO: 211 - protein, 73 aa, Artificial sequence
  artificial construct
MGSWTEFWERLYAIEYRLFALGGSEAELAAFEKEIAAFESELQAYKGKGNPEVEKLRSVAATIRYELQAYRHN

SEQ ID NO: 212 - protein, 73 aa, Artificial sequence
  artificial construct
MGSWNEFWERLYAIELRLFALGGSEAELAAFEKEIAAFESELQAYKGKGNPEVEKLRMTAAYIRNELQAYRHN

SEQ ID NO: 213 - protein, 73 aa, Artificial sequence
  artificial construct
MGSWYEFWKRLYAIEYRLFALGGSEAELAAFEKEIAAFESELQAYKGKGNPEVEALRKVAAKIREQLQAYRHN

SEQ ID NO: 214 - protein, 73 aa, Artificial sequence
  artificial construct
MGSWTEFWARLYAIEMRLFALGGSEAELAAFEKEIAAFESELQAYKGKGNPEVEHLRRVAALIREQLQAYRHN

SEQ ID NO: 215 - protein, 73 aa, Artificial sequence
  artificial construct
MGSWHEFWDRLYAIEFRLFALGGSEAELAAFEKEIAAFESELQAYKGKGNPEVESLRQVAAKIRWHLQAYRHN

SEQ ID NO: 216 - protein, 73 aa, Artificial sequence
  artificial construct
MGSWDEFEFRLGALRWRLIALGGSEAELAAFEKEIAAFESELQAYKGKGNPEVEYLRFGAAHIRHILQAYRHN

SEQ ID NO: 217 - protein, 73 aa, Artificial sequence
  artificial construct
MGSWTEFYHRLYAIRERLSALGGSEAELAAFEKEIAAFESELQAYKGKGNPEVEYLRFGAAHIRHLLQAYRHN

SEQ ID NO: 218 - protein, 73 aa, Artificial sequence
  artificial construct
MGSWVEFETRLDAIRMRLGALGGSEAELAAFEKEIAAFESELQAYKGKGNPEVEYLRFGAAHIRALLQAYRHN

SEQ ID NO: 219 - protein, 73 aa, Artificial sequence
  artificial construct
MGSWGEFDVRLFAIRERLSALGGSEAELAAFEKEIAAFESELQAYKGKGNPEVEYLRGYAAQIRSFLQAYRHN

SEQ ID NO: 220 - protein, 73 aa, Artificial sequence
  artificial construct
MGSWVEFDERLSAIRERLDALGGSEAELAAFEKEIAAFESELQAYKGKGNPEVEYLRLYAAQIRVFLQAYRHN

SEQ ID NO: 221 - protein, 73 aa, Artificial sequence
  artificial construct
MGSWSEFDGRLGAIWDRLYALGGSEAELAAFEKEIAAFESELQAYKGKGNPEVEYLRDRAAQIREFLQAYRHN

SEQ ID NO: 222 - protein, 73 aa, Artificial sequence
  artificial construct
MGSWGEFEGRLHAIRSRLSALGGSEAELAAFEKEIAAFESELQAYKGKGNPEVEVLRGYAAWIRALLQAYRHN

SEQ ID NO: 223 - protein, 73 aa, Artificial sequence
  artificial construct
MGSWGEFNGRLGAIRERLQALGGSEAELAAFEKEIAAFESELQAYKGKGNPEVEFLRAYAASIRAVLQAYRHN

SEQ ID NO: 224 - protein, 73 aa, Artificial sequence
  artificial construct
MGSWWEFTFRLAAIEFRLEALGGSEAELAAFEKEIAAFESELQAYKGKGNPEVEDLRAIAAEIRKSLQAYRHN

SEQ ID NO: 225 - protein, 73 aa, Artificial sequence
  artificial construct
MGSWDEFQFRLAAIGFRLGALGGSEAELAAFEKEIAAFESELQAYKGKGNPEVEVLRRQAARIRHLLQAYRHN

SEQ ID NO: 226 - protein, 73 aa, Artificial sequence
  artificial construct
MGSWYEFVTRLHAIDHRLKALGGSEADLAAFEKEIAAFESELQAYKGKGNPEVEWLRFYAAGIRMNLQAYRHN

SEQ ID NO: 227 - protein, 73 aa, Artificial sequence
  artificial construct
MGSWSIEFWRLEAIKFRLIALGGSEAELAAFEKEIAAFESELQAYKGKGNPEVEFLRVEAAAIRRVLQAYRHN

SEQ ID NO: 228 - protein, 73 aa, Artificial sequence
  artificial construct
MGSWGEFEHRLDPSTCVWLALGGSEAELAAFEKEIAAFESELQAYKGKGNPEVEKLRRGAAVIRHWLQAYRHN

SEQ ID NO: 229 - protein, 73 aa, Artificial sequence
  artificial construct
MGSWIEFAMRLEAIENRLTALGGSEAELAIFESMIAHFEELLQNYKGKGNPEVEALIHEAFAIHKELWAYRHN

SEQ ID NO: 230 - protein, 73 aa, Artificial sequence
  artificial construct
MGSWNEFYQRLEAIENRLQALGGSEAELAMFEVRIALFEDMLQGYKGKGNPEVEALKQEAIAILRELIAYRHN

SEQ ID NO: 231 - protein, 73 aa, Artificial sequence
  artificial construct
MGSWNEFYDRLRAIKKRLYALGGSEAELADFEEDIAQFEVDLQDYKGKGNPEVEALHREAHAITHELWAYRHN

SEQ ID NO: 232 - protein, 73 aa, Artificial sequence
  artificial construct
MGSWGEFKHRLALIKWYLEALGGSEAELAHFEDWIAVFEVQLQNYKGKGNPEVEALRKEAAAIRDELQAYRHN

SEQ ID NO: 233 - protein, 73 aa, Artificial sequence
  artificial construct
MGSWYEFKHRLAIIKWYLEALGGSEAELAKFEAWIAEFEMILQRYKGKGNPEVEALRKEAAAIRDELQAYRHN

SEQ ID NO: 234 - protein, 73 aa, Artificial sequence
  artificial construct
MGSWYEFKHRLAIIKWYLEALGGSEAELAHFEQYIADFEGTLQKYKGKGNPEVEALRKEAAAIRDELQAYRHN

SEQ ID NO: 235 - protein, 73 aa, Artificial sequence
  artificial construct
MGSWYNFKHRLAIIKWYLEALGGSEAELARFENFIANFETQLQLYKGKGNPEVEALRKEAAAIRDELQAYRHN

SEQ ID NO: 236 - protein, 73 aa, Artificial sequence
  artificial construct
MGSWFQFKHRLAIIKWQLEALGGSEAELAWFEQWIADFEHQLQHYKGKGNPEVEALRKEAAAIRDELQAYRHN

SEQ ID NO: 237 - protein, 73 aa, Artificial sequence
  artificial construct
MGSWYNFKHRLAIIKWFLEALGGSEAELAVFEVWIADFEHQLQEYKGKGNPEVEALRKEAAAIRDELQAYRHN

SEQ ID NO: 238 - protein, 73 aa, Artificial sequence
  artificial construct
MGSWDAFKHRLALIKWYLEALGGSEAELAHFEEYIAEFESNLQSYKGKGNPEVEALRKEAAAIRDELQAYRHN

SEQ ID NO: 239 - protein, 73 aa, Artificial sequence
  artificial construct
MGSWDGFKHRLALIKWYLEALGGSEAELANFENWIAEFEQRLQYYKGKGNPEVEALRKEAAAIRDELQAYRHN

SEQ ID NO: 240 - protein, 73 aa, Artificial sequence
  artificial construct
MGSWNGFKHRLAIIKWYLEALGGSEAELASFESYIAEFESGLQEYKGKGNPEVEALRKEAAAIRDELQAYRHN

SEQ ID NO: 241 - protein, 73 aa, Artificial sequence
  artificial construct
MGSWNSFKHRLALIKWYLEALGGSEAELATFEWYIASFESELQQYKGKGNPEVEALRKEAAAIRDELQAYRHN

SEQ ID NO: 242 - protein, 73 aa, Artificial sequence
  artificial construct
MGSWSDFKYRLAVIKFYLEALGGSEAELASFESFIAHFEDDLQKYKGKGNPEVEALRKEAAAIRDELQAYRHN

SEQ ID NO: 243 - protein, 73 aa, Artificial sequence
  artificial construct
MGSWSGFKYRLAVIKFYLEALGGSEAELASFELFIAKFEIDLQNYKGKGNPEVEALRKEAAAIRDELQAYRHN

SEQ ID NO: 244 - protein, 73 aa, Artificial sequence
  artificial construct
MGSWYGFKYRLAVIKWYLEALGGSEAELASFEKYIAHFEHDLQAYKGKGNPEVEALRKEAAAIRDELQAYRHN

SEQ ID NO: 245 - protein, 73 aa, Artificial sequence
  artificial construct
MGSWYGFKYRLAVIKWYLEALGGSEAELASFEKYIAQFEHDLQAYKGKGNPEVEALRKEAAAIRDELQAYRHN

SEQ ID NO: 246 - protein, 73 aa, Artificial sequence
  artificial construct
MGSWYGFKYRLALIKWYLEALGGSEAELASFETYIADFEDLLQAYKGKGNPEVEALRKEAAAIRDELQAYRHN

SEQ ID NO: 247 - protein, 73 aa, Artificial sequence
  artificial construct
MGSWSTFKYHLAVIKWYLEALGGSEAELASFEDYIAQFETDLQEYKGKGNPEVEALRKEAAAIRDELQAYRHN

SEQ ID NO: 248 - protein, 73 aa, Artificial sequence
  artificial construct
MGSWHEFKYRLALIKWYLEALGGSEAELATFEHHIAQFEWDLQKYKGKGNPEVEALRKEAAAIRDELQAYRHN

SEQ ID NO: 249 - protein, 73 aa, Artificial sequence
  artificial construct
MGSWNMFKYRLAHIKWYLEALGGSEAELATFEAYIADFEVDLQKYKGKGNPEVEALRKEAAAIRDELQAYRHN

SEQ ID NO: 250 - protein, 73 aa, Artificial sequence
  artificial construct
MGSWHGFKYRLAIIKWWLEALGGSEAELAFFEEWIASFERDLQIYKGKGNPEVEALRKEAAAIRDELQAYRHN

SEQ ID NO: 251 - protein, 73 aa, Artificial sequence
  artificial construct
MGSWHGFKYRLAVIKWYLEALGGSEAELAMFEGWIAQFEITLQQYKGKGNPEVEALRKEAAAIRDELQAYRHN

SEQ ID NO: 252 - protein, 73 aa, Artificial sequence
  artificial construct
MGSWQGFKYRLAVIKWMLEALGGSEAELAFFENWIAEFETKLQQYKGKGNPEVEALRKEAAAIRDELQAYRHN

SEQ ID NO: 253 - protein, 73 aa, Artificial sequence
  artificial construct
MGSWSGFKYRLAVIKWYLEALGGSEAELATFEEWIAEFETELQFYKGKGNPEVEALRKEAAAIRDELQAYRHN

SEQ ID NO: 254 - protein, 73 aa, Artificial sequence
  artificial construct
MGSWGYFKYRLAMIKWYLEALGGSEAELASFESWIAEFEGSLQAYKGKGNPEVEALRKEAAAIRDELQAYRHN

SEQ ID NO: 255 - protein, 73 aa, Artificial sequence
  artificial construct
MGSWHAFKYKLAMIKWYLEALGGSEAELAHFEEWIAEFEALLQEYKGKGNPEVEALRKEAAAIRDELQAYRHN

SEQ ID NO: 256 - protein, 73 aa, Artificial sequence
  artificial construct
MGSWQHFKYRLAIIKWYLEALGGSEAELAFFESFIAKFEHDLQKYKGKGNPEVEALRKEAAAIRDELQAYRHN

SEQ ID NO: 257 - protein, 73 aa, Artificial sequence
  artificial construct
MGSWNDFKYRLAIIKYYLEALGGSEAELAHFESYIASFEHDLQNYKGKGNPEVEALRKEAAAIRDELQAYRHN

SEQ ID NO: 258 - protein, 73 aa, Artificial sequence
  artificial construct
MGSWGAFKYRLAIIKFYLEALGGSEAELARFEEFIANFEHDLQNYKGKGNPEVEALRKEAAAIRDELQAYRHN

SEQ ID NO: 259 - protein, 73 aa, Artificial sequence
  artificial construct
MGSWYNFKYRLAIIKFYLEALGGSEAELAQFEIWIAEFEHDLQGYKGKGNPEVEALRKEAAAIRDELQAYRHN

SEQ ID NO: 260 - protein, 73 aa, Artificial sequence
  artificial construct
MGSWEQFKYRLAIIKYMLEALGGSEAELAWFESWIANFESDLQHYKGKGNPEVEALRKEAAAIRDELQAYRHN

SEQ ID NO: 261 - protein, 73 aa, Artificial sequence
  artificial construct
MGSWQQFKYRLAIIKYYLEALGGSEAELAGFETYIAKFEEVLQSYKGKGNPEVEALRKEAAAIRDELQAYRHN

SEQ ID NO: 262 - protein, 73 aa, Artificial sequence
  artificial construct
MGSWAGFKYRLAVIKYYLEALGGSEAELAHFEQWIAHFEGMLQDYKGKGNPEVEALRKEAAAIRDELQAYRHN

SEQ ID NO: 263 - protein, 73 aa, Artificial sequence
  artificial construct
MGSWTAFKYRLAIIKFYLEALGGSEAELAHFESYIAHFEDMLQHYKGKGNPEVEALRKEAAAIRDELQAYRHN

SEQ ID NO: 264 - protein, 73 aa, Artificial sequence
  artificial construct
MGSWAHFKYRLAIIKFWLEALGGSEAELANFEEYIAEFESTLQVYKGKGNPEVEALRKEAAAIRDELQAYRHN

SEQ ID NO: 265 - protein, 73 aa, Artificial sequence
  artificial construct
MGSWANFKYRLALIKWHLEALGGSEAELASFEIWIADFEESLQWYKGKGNPEVEALRKEAAAIRDELQAYRHN

SEQ ID NO: 266 - protein, 73 aa, Artificial sequence
  artificial construct
MGSWATFKYRLALIKWHLEALGGSEAELADFEEYIAGFEEGLQKYKGKGNPEVEALRKEAAAIRDELQAYRHN

SEQ ID NO: 267 - protein, 73 aa, Artificial sequence
  artificial construct
MGSWTHFKYRLALIKWWLEALGGSEAELAGFEVHIADFEAQLQMYKGKGNPEVEALRKEAAAIRDELQAYRHN

SEQ ID NO: 268 - protein, 73 aa, Artificial sequence
  artificial construct
MGSWNTFKYHLAVIKFMLEALGGSEAELAFFEQWIAEFEVTLQSYKGKGNPEVEALRKEAAAIRDELQAYRHN

SEQ ID NO: 269 - protein, 73 aa, Artificial sequence
  artificial construct
MGSWTQFKYHLAVIKWYLEALGGSEAELAGFEQWIAEFEKTLQEYKGKGNPEVEALRKEAAAIRDELQAYRHN

SEQ ID NO: 270 - protein, 73 aa, Artificial sequence
  artificial construct
MGSWNQFKYRLAVIKFYLEALGGSEAELAHFETWIAAFEEQLQFYKGKGNPEVEALRKEAAAIRDELQAYRHN

SEQ ID NO: 271 - protein, 73 aa, Artificial sequence
  artificial construct
MGSWNEFKYHLAVIKFYLEALGGSEAELAHFETWIAEFEYELQKYKGKGNPEVEALRKEAAAIRDELQAYRHN

SEQ ID NO: 272 - protein, 73 aa, Artificial sequence
  artificial construct
MGSWVQFKYHLAVIKFYLEALGGSEAELAHFETWIAEFEVALQGYKGKGNPEVEALRKEAAAIRDELQAYRHN

SEQ ID NO: 273 - protein, 73 aa, Artificial sequence
  artificial construct
MGSWVDFKYHLAVIKFWLEALGGSEAELANFETWIANFEQELQMYKGKGNPEVEALRKEAAAIRDELQAYRHN

SEQ ID NO: 274 - protein, 73 aa, Artificial sequence
  artificial construct
MGSWVDFKYHLAVIKWYLEALGGSEAELADFENWIAHFESILQQYKGKGNPEVEALRKEAAAIRDELQAYRHN

SEQ ID NO: 275 - protein, 73 aa, Artificial sequence
  artificial construct
MGSWVEFKYHLAVIKFTLEALGGSEAELADFEEEIARFEMILQQYKGKGNPEVEALRKEAAAIRDELQAYRHN

SEQ ID NO: 276 - protein, 73 aa, Artificial sequence
  artificial construct
MGSWSHFKYHLALIKWYLEALGGSEAELAKFEFWIAEFEHNLQMYKGKGNPEVEALRKEAAAIRDELQAYRHN

SEQ ID NO: 277 - protein, 73 aa, Artificial sequence
  artificial construct
MGSWYHFKYHLALIKWYLEALGGSEAELAHFEHWIAEFEWTLQQYKGKGNPEVEALRKEAAAIRDELQAYRHN

SEQ ID NO: 278 - protein, 73 aa, Artificial sequence
  artificial construct
MGSWQGFKYHLALIKFYLEALGGSEAELAHFEHWLAEFEHDLQTYKGKGNPEVEALRKEAAAIRDELQAYRHN

SEQ ID NO: 279 - protein, 73 aa, Artificial sequence
  artificial construct
MGSWLSFKHHLALIKWYLEALGGSEAELASFEAWIALFEHQLQQYKGKGNPEVEALRKEAAAIRDELQAYRHN

SEQ ID NO: 280 - protein, 73 aa, Artificial sequence
  artificial construct
MGSWSEFKYKLALIKWYLEALGGSEAELAHFEGWIANFETTLQKYKGKGNPEVEALRKEAAAIRDELQAYRHN

SEQ ID NO: 281 - protein, 73 aa, Artificial sequence
  artificial construct
MGSWIEFKYKLAIIKFYLEALGGSEAELAHFEHWIADFEFVLQQYKGKGNPEVEALRKEAAAIRDELQAYRHN

SEQ ID NO: 282 - protein, 73 aa, Artificial sequence
  artificial construct
MGSWQNFKYHLAMIKWYLEALGGSEAELANFEEFIAQFEINLQHYKGKGNPEVEALRKEAAAIRDELQAYRHN

SEQ ID NO: 283 - protein, 73 aa, Artificial sequence
  artificial construct
MGSWYNFKYHLAIIKWWLEALGGSEAELADFEHYIADFERNLQEYKGKGNPEVEALRKEAAAIRDELQAYRHN

SEQ ID NO: 284 - protein, 73 aa, Artificial sequence
  artificial construct
MGSWYQFKYHLAIIKWYLEALGGSEAELAGFENYIATFEQELQQYKGKGNPEVEALRKEAAAIRDELQAYRHN

SEQ ID NO: 285 - protein, 73 aa, Artificial sequence
  artificial construct
MGSWSHFKYHLAIIKFYLEALGGSEAELAGFEIWIAKFEDELQMYKGKGNPEVEALRKEAAAIRDELQAYRHN

SEQ ID NO: 286 - protein, 73 aa, Artificial sequence
  artificial construct
MGSWVGFKAHLAIIKWYLEALGGSEAELAGFEIFIADFEALLQMYKGKGNPEVEALRKEAAAIRDELQAYRHN

SEQ ID NO: 287 - protein, 73 aa, Artificial sequence
  artificial construct
MGSWVNFKYKLAIIKYMLEALGGSEAELAFFEDWIAEFERTLQQYKGKGNPEVEALRKEAAAIRDELQAYRHN

SEQ ID NO: 288 - protein, 73 aa, Artificial sequence
  artificial construct
MGSWSNFKYRLAVIKYMLEALGGSEAELAFFEDWIADFELHLQVYKGKGNPEVEALRKEAAAIRDELQAYRHN

SEQ ID NO: 289 - protein, 73 aa, Artificial sequence
  artificial construct
MGSWTNFKYKLAVIKFMLEALGGSEAELAFFEDWIAGFEIDLQNYKGKGNPEVEALRKEAAAIRDELQAYRHN

SEQ ID NO: 290 - protein, 73 aa, Artificial sequence
  artificial construct
MGSWTGFKYRLAIIKFMLEALGGSEAELAFFEQWIADFENELQYYKGKGNPEVEALRKEAAAIRDELQAYRHN

SEQ ID NO: 291 - protein, 73 aa, Artificial sequence
  artificial construct
MGSWHNFKYRLAIIKFMLEALGGSEAELAWFENWIADFEDSLQDYKGKGNPEVEALRKEAAAIRDELQAYRHN

SEQ ID NO: 292 - protein, 73 aa, Artificial sequence
  artificial construct
MGSWFAFKHRLAVIKYMLEALGGSEAELAFFEHWIAQFEHDLQQYKGKGNPEVEALRKEAAAIRDELQAYRHN

SEQ ID NO: 293 - protein, 73 aa, Artificial sequence
  artificial construct
MGSWYEFKHRLAVIKYMLEALGGSEAELAFFENWIAQFEHELQTYKGKGNPEVEALRKEAAAIRDELQAYRHN

SEQ ID NO: 294 - protein, 73 aa, Artificial sequence
  artificial construct
MGSWYKFKHKLAVIKYMLEALGGSEAELAWFEEWIAEFEVTLQDYKGKGNPEVEALRKEAAAIRDELQAYRHN

SEQ ID NO: 295 - protein, 73 aa, Artificial sequence
  artificial construct
MGSWFYFKQKLAFIKWYLEALGGSEAELANFEIYIAEFEVMLQQYKGKGNPEVEALRKEAAAIRDELQAYRHN

SEQ ID NO: 296 - protein, 73 aa, Artificial sequence
  artificial construct
MGSWFSFKHHLAVIKWNLEALGGSEAELASFEEQIAEFESVLQAYKGKGNPEVEALRKEAAAIRDELQAYRHN

SEQ ID NO: 297 - protein, 73 aa, Artificial sequence
  artificial construct
MGSWGNFKYRLAIIKFHLEALGSSEAELATFEAWIANFESMLQNYKGKGNPEVEALRKEAAAIRDELQAYRHN

SEQ ID NO: 298 - protein, 73 aa, Artificial sequence
  artificial construct
MGSWSYFKYGLAIIKIRLEALGGSEAELADFERWIAAFEHDLQYYKGKGNPEVEALRKEAAAIRDELQAYRHN

SEQ ID NO: 299 - protein, 73 aa, Artificial sequence
  artificial construct
MGSWSYFKFGLAHIKLRLEALGGSEAELADFEQWIASFEEQLQTYKGKGNPEVEALRKEAAAIRDELQAYRHN

SEQ ID NO: 300 - protein, 73 aa, Artificial sequence
  artificial construct
MGSWSYFKWGLAHIKLRLEALGGSEAELADFEFWIAEFEGLLQDYKGKGNPEVEALRKEAAAIRDELQAYRHN

SEQ ID NO: 301 - protein, 73 aa, Artificial sequence
  artificial construct
MGSWIYFKYGLAHIKTRLEALGGSEAELADFEQWIAEFEKMLQDYKGKGNPEVEALRKEAAAIRDELQAYRHN

SEQ ID NO: 302 - protein, 73 aa, Artificial sequence
  artificial construct
MGSWGYFKYGLATIKHRLEALGGSEAELADFELWIAKFEEQLQVYKGKGNPEVEALRKEAAAIRDELQAYRHN

SEQ ID NO: 303 - protein, 73 aa, Artificial sequence
  artificial construct
MGSWEYFKYGLATIKMHLEALGGSEAELADFEHWIAHFEHQLQMYKGKGNPEVEALRKEAAAIRDELQAYRHN

SEQ ID NO: 304 - protein, 73 aa, Artificial sequence
  artificial construct
MGSWSYFKYGLATIKEKLEALGGSEAELADFETWIAMFEKQLQEYKGKGNPEVEALRKEAAAIRDELQAYRHN

SEQ ID NO: 305 - protein, 73 aa, Artificial sequence
  artificial construct
MGSWHYFKNGLAIIKEKLEALGGSEAELADFEIWIAMFEMELQEYKGKGNPEVEALRKEAAAIRDELQAYRHN

SEQ ID NO: 306 - protein, 73 aa, Artificial sequence
  artificial construct
MGSWQYFKYGLAIIKIKLEALGGSEAELADFEAWIATFEKQLQHYKGKGNPEVEALRKEAAAIRDELQAYRHN

SEQ ID NO: 307 - protein, 73 aa, Artificial sequence
  artificial construct
MGSWVYFKHGLAVIKMRLEALGGSEAELADFETWIAQFEMTLQEYKGKGNPEVEALRKEAAAIRDELQAYRHN

SEQ ID NO: 308 - protein, 73 aa, Artificial sequence
  artificial construct
MGSWVYFKYGLAVIKEKLEALGGSEAELADFETWIAEFEFGLQQYKGKGNPEVEALRKEAAAIRDELQAYRHN

SEQ ID NO: 309 - protein, 73 aa, Artificial sequence
  artificial construct
MGSWYYFKYGLAVIKGKLEALGGSEAELADFETWIAKFENHLQSYKGKGNPEVEALRKEAAAIRDELQAYRHN

SEQ ID NO: 310 - protein, 73 aa, Artificial sequence
  artificial construct
MGSWTYFKYGLALIKYRLEALGGSEAELADFEEWIAQFEVSLQHYKGKGNPEVEALRKEAAAIRDELQAYRHN

SEQ ID NO: 311 - protein, 73 aa, Artificial sequence
  artificial construct
MGSWDYFKYGLALIKIKLEALGGSEAELADFEVWIAQFEMALQVYKGKGNPEVEALRKEAAAIRDELQAYRHN

SEQ ID NO: 312 - protein, 73 aa, Artificial sequence
  artificial construct
MGSWTYFKFGLAHIKDSLEALGGSEAELADFEQWIAMFEQDLQVYKGKGNPEVEALRKEAAAIRDELQAYRHN

SEQ ID NO: 313 - protein, 73 aa, Artificial sequence
  artificial construct
MGSWGYFKHGLAHIKSSLEALGGSEAELADFEVWIAAFENELQEYKGKGNPEVEALRKEAAAIRDELQAYRHN

SEQ ID NO: 314 - protein, 73 aa, Artificial sequence
  artificial construct
MGSWGYFKTGLAIIKAQLEALGGSEAELADFELWIAQFEETLQFYKGKGNPEVEALRKEAAAIRDELQAYRHN

SEQ ID NO: 315 - protein, 73 aa, Artificial sequence
  artificial construct
MGSWAYFKYGLAVIKLHLEALGGSEAELADFERYIAEFEYELQAYKGKGNPEVEALRKEAAAIRDELQAYRHN

SEQ ID NO: 316 - protein, 73 aa, Artificial sequence
  artificial construct
MGSWLDFKEGLADIKRSLEALGGSEAELADFEGVIALFEWKLQTYKGKGNPEVEALRKEAAAIRDELQAYRHN

SEQ ID NO: 317 - protein, 73 aa, Artificial sequence
  artificial construct
MGSWEVFKHELAVIKDYLEALGGSEAELAHFEWGIAWFEGFLQDYKGKGNPEVEALRKEAAAIRDELQAYRHN

SEQ ID NO: 318 - protein, 73 aa, Artificial sequence
  artificial construct
MGSWIVFKQSLAWIKEHLEALGGSEAELAEFEFYIANFEHTLQNYKGKGNPEVEALRKEAAAIRDELQAYRHN

SEQ ID NO: 319 - protein, 73 aa, Artificial sequence
  artificial construct
MGSWIYFKDSLAYIKKYLEALGGSEAELATFEYYIANFEHELQYYKGKGNPEVEALRKEAAAIRDELQAYRHN

SEQ ID NO: 320 - protein, 73 aa, Artificial sequence
  artificial construct
MGSWDHFKYNLAWIKKYLEALGGSEAELATFEWYIANFEKRLQDYKGKGNPEVEALRKEAAAIRDELQAYRHN

SEQ ID NO: 321 - protein, 73 aa, Artificial sequence
  artificial construct
MGSWFTFKQNLAWIKLHLEALGGSEAELARFEYYIADFENKLQLYKGKGNPEVEALRKEAAAIRDELQAYRHN

SEQ ID NO: 322 - protein, 73 aa, Artificial sequence
  artificial construct
MGSWREFKYGLAHIKRVLEALGGSEAELAVFEYYIAKFEQELQEYKGKGNPEVEALRKEAAAIRDELQAYRHN

SEQ ID NO: 323 - protein, 73 aa, Artificial sequence
  artificial construct
MGSWIQFKYGLAHIKRTLEALGGSEAELAVFEWYIADFEQQLQGYKGKGNPEVEALRKEAAAIRDELQAYRHN

SEQ ID NO: 324 - protein, 73 aa, Artificial sequence
  artificial construct
MGSWVEFKHNLAWIKVTLEALGGSEAELAVFEYYIAQFEEQLQEYKGKGNPEVEALRKEAAAIRDELQAYRHN

SEQ ID NO: 325 - protein, 73 aa, Artificial sequence
  artificial construct
MGSWISFKDNLAMIKEFLEALGGSEAELAVFEWYIATFEVELQDYKGKGNPEVEALRKEAAAIRDELQAYRHN

SEQ ID NO: 326 - protein, 73 aa, Artificial sequence
  artificial construct
MGSWHIFKDNLATIKAFLEALGGSEAELAVFEWYIAKFEEELQGYKGKGNPEVEALRKEAAAIRDELQAYRHN

SEQ ID NO: 327 - protein, 73 aa, Artificial sequence
  artificial construct
MGSWTSFKHGLAGIKRVLEALGGSEAELATFEWYIAQFERHLQAYKGKGNPEVEALRKEAAAIRDELQAYRHN

SEQ ID NO: 328 - protein, 73 aa, Artificial sequence
  artificial construct
MGSWQSFKHALADIKINLEALGGSEAELAQFEYAIAVFEYRLQAYKGKGNPEVEALRKEAAAIRDELQAYRHN

SEQ ID NO: 329 - protein, 73 aa, Artificial sequence
  artificial construct
MGSWHTFKEALAQIKGELEALGGSEAELASFEYAIAVFEYRLQMYKGKGNPEVEALRKEAAAIRDELQAYRHN

SEQ ID NO: 330 - protein, 73 aa, Artificial sequence
  artificial construct
MGSWTDFKTSLADIKAELEALGGSEAELAKFEYYIAIFEYRLQEYKGKGNPEVEALRKEAAAIRDELQAYRHN

SEQ ID NO: 331 - protein, 73 aa, Artificial sequence
  artificial construct
MGSWTNFKEGLAEIKRDLEALGGSEAELARFEYVIAVFEFRLQNYKGKGNPEVEALRKEAAAIRDELQAYRHN

SEQ ID NO: 332 - protein, 73 aa, Artificial sequence
  artificial construct
MGSWHTFKDGLAEIKSELEALGGSEAELAMFEYVIAIFEYRLQNYKGKGNPEVEALRKEAAAIRDELQAYRHN

SEQ ID NO: 333 - protein, 73 aa, Artificial sequence
  artificial construct
MGSWQFFKEHLASIKFWLEALGGSEAELAFFEDAIADFEYHLQNYKGKGNPEVEALRKEAAAIRDELQAYRHN

SEQ ID NO: 334 - protein, 73 aa, Artificial sequence
  artificial construct
MGSWTYFKEHLASIKFWLEALGGSEAELAFFEDAIAEFEKDLQYYKGKGNPEVEALRKEAAAIRDELQAYRHN

SEQ ID NO: 335 - protein, 73 aa, Artificial sequence
  artificial construct
MGSWIIFKGYLAHIKHHLEALGGSEAELADFEFYIAIFEMELQKYKGKGNPEVEALRKEAAAIRDELQAYRHN

SEQ ID NO: 336 - protein, 73 aa, Artificial sequence
  artificial construct
MGSWYLFQSHLAHIKHHLEALGGSEAELAWFEFTIAGFEQELQHYKGKGNPEVEALRKEAAAIRDELQAYRHN

SEQ ID NO: 337 - protein, 73 aa, Artificial sequence
  artificial construct
MGSWYSFKWTLARIKLELEALGGSEAELAYFENVIAHFEMELQSYKGKGNPEVEALRKEAAAIRDELQAYRHN

SEQ ID NO: 338 - protein, 73 aa, Artificial sequence
  artificial construct
MGSWTTLKWRLAHIKQHLEALGGSEAELALFEYDIAHFEELLQYYKGKGNPEVEALRKEAAAIRDELQAYRHN

SEQ ID NO: 339 - protein, 73 aa, Artificial sequence
  artificial construct
MGSWYGFKWYLATIKKHLEALGGSEAELALFETEIATFELWLQDYKGKGNPEVEALRKEAAAIRDELQAYRHN

SEQ ID NO: 340 - protein, 73 aa, Artificial sequence
  artificial construct
MGSWIEFNMRVLAIEDRLWALGGSEAELAAFEKEIAAFESELQAYKGKGNPEVESLRYEACLDPWSSAAYRHN

SEQ ID NO: 341 - protein, 73 aa, Artificial sequence
  artificial construct
MGSWIEFHERLWAIEDRLWALGGSEAELAAFEKEIAAFESELQAYKGKGNPEVESLREMAASIRHGLQAYRHN

SEQ ID NO: 342 - protein, 73 aa, Artificial sequence
  artificial construct
MGSWFEFYERLWAIDDRLWALGGSEAELAAFEKEIAAFESELQAYKGKGNPEVEWLREEAASIRSSLQAYRHN

SEQ ID NO: 343 - protein, 73 aa, Artificial sequence
  artificial construct
MGSWFEFWDRLEAIDDRLFALGGSEAELAAFEKEIAAFESELQAYKGKGNPEVESLRYNAAEIRKELQAYRHN

SEQ ID NO: 344 - protein, 73 aa, Artificial sequence
  artificial construct
MGSWHEFWSRLDAIDDRLFALGGSEAELAAFEKEIAAFESELQAYKGKGNPEVEYLRGAAADIRAELQAYRHN

SEQ ID NO: 345 - protein, 73 aa, Artificial sequence
  artificial construct
MGSWYEFWIRLEAIDDRLFALGGSEAELAAFEKEIAAFESELQAYKGKGNPEVDILRDFAADIRTELQAYRHN

SEQ ID NO: 346 - protein, 73 aa, Artificial sequence
  artificial construct
MGSWHEFWDRLEAIDDRLYALGGSEAELAAFEKEIAAFESELQAYKGKGNPEVEFLREEAAYIRELLQAYRHN

SEQ ID NO: 347 - protein, 73 aa, Artificial sequence
  artificial construct
MGSWEEFWDRLFAIDDRLWALGGSEAELAAFEKEIAAFESELQAYKGKGNPEVETLRNEAAEIRMALQAYRHN

SEQ ID NO: 348 - protein, 73 aa, Artificial sequence
  artificial construct
MGSWWEFDDRLFAIDTRLMALGGSEAELAAFEKEIAAFESELQAYKGKGNPEVESLREWAATIRMELQAYRHN

SEQ ID NO: 349 - protein, 73 aa, Artificial sequence
  artificial construct
MGSWTEFHDRLEAIDDRLWALGGSEAELAAFEKEIAAFESELQAYKGKGNPEVEYLREEAAQIRWELQAYRHN

SEQ ID NO: 350 - protein, 73 aa, Artificial sequence
  artificial construct
MGSWAEFEDRLWAIEDRLWALGGSEAELAAFEKEIAAFESELQAYKGKGNPEVEYLREEAAAIRFELQAYRHN

SEQ ID NO: 351 - protein, 73 aa, Artificial sequence
  artificial construct
MGSWVEFWFRLEAIDSRLWALGGSEAELAAFEKEIAAFESELQAYKGKGNPEVEWLREEAAAIREDLQAYRHN

SEQ ID NO: 352 - protein, 73 aa, Artificial sequence
  artificial construct
MGSWVEFWQRLEAIESRLWALGGSEAELAAFEKEIAAFESELQAYKGKGNPEVEFLREEAAEIRWELQAYRHN

SEQ ID NO: 353 - protein, 73 aa, Artificial sequence
  artificial construct
MGSWSEFWQRLEAIEDRLWALGGSEAELAAFEKEIAAFESELQAYKGKGNPEVEWLRENAAMIRDELQAYRHN

SEQ ID NO: 354 - protein, 73 aa, Artificial sequence
  artificial construct
MGSWSEFITRLEAIDDRLWALGGSEAELAAFEKEIAAFESELQAYKGKGNPEVEILREEAAEIRQHLQAYRHN

SEQ ID NO: 355 - protein, 73 aa, Artificial sequence
  artificial construct
MGSWYEFETRLEAIYDRLWALGGSEAELAAFEKEIAAFESELQAYKGKGNPEVELLRVEAAEIREDLQAYRHN

SEQ ID NO: 356 - protein, 73 aa, Artificial sequence
  artificial construct
MGSWTEFYYRLEAIEDRLWALGGSEAELAAFEKEIAAFESELQAYKGKGNPEVEFLRVEAANIRDMLQAYRHN

SEQ ID NO: 357 - protein, 73 aa, Artificial sequence
  artificial construct
MGSWYEFVIRLEAIEDRLWALGGSEAELAAFEKEIAAFESELQAYKGKGNPEVEVLRWYAADIRHELQAYRHN

SEQ ID NO: 358 - protein, 73 aa, Artificial sequence
  artificial construct
MGSWTEFSIRLEAIYDRLVALGGSEAELAAFEKEIAAFESELQAYKGKGNPEVEVLRTYAANIRHELQAYRHN

SEQ ID NO: 359 - protein, 73 aa, Artificial sequence
  artificial construct
MGSWTEFSIRLEAIYDRLVALGGSEAELAAFEKEIAAFESELQAYKGKGNPEVEVLRTYAAFIRHELQAYRHN

SEQ ID NO: 360 - protein, 73 aa, Artificial sequence
  artificial construct
MGSWTEFVWRLEAIWDRLDALGGSEAELAAFEKEIAAFESELQAYKGKGNPEVEVLREDAAVIRHFLQAYRHN

SEQ ID NO: 361 - protein, 73 aa, Artificial sequence
  artificial construct
MGSWVEFHERLEAIEDRLMALGGSEAELAAFEKEIAAFESELQAYKGKGNPEVEYLREDAAFIRQLLQAYRHN

SEQ ID NO: 362 - protein, 73 aa, Artificial sequence
  artificial construct
MGSWVEFHDRLEAIEDRLYALGGSEAELAAFEKEIAAFESELQAYKGKGNPEVEWLREDAAYIRSILQAYRHN

SEQ ID NO: 363 - protein, 73 aa, Artificial sequence
  artificial construct
MGSWIEFYDRLEAIYDRLDALGGSEAELAAFEKEIAAFESELQAYKGKGNPEVEWLREDAAFIRSWLQAYRHN

SEQ ID NO: 364 - protein, 73 aa, Artificial sequence
  artificial construct
MGSWVEFDQRLEAIYDRLYALGGSEAELAAFEKEIAAFESELQAYKGKGNPEVEWLREDAAQIRKWLQAYRHN

SEQ ID NO: 365 - protein, 73 aa, Artificial sequence
  artificial construct
MGSWVEFHDRLEAIEDRLLALGGSEAELAAFEKEIAAFESELQAYKGKGNPEVEDLREYAAGIRWFLQAYRHN

SEQ ID NO: 366 - protein, 73 aa, Artificial sequence
  artificial construct
MGSWEEFAQRLYAIEWRLYALGGSEAELAAFEKEIAAFESELQAYKGKGNPEVEVLRYVAAQIRYHLQAYRHN

SEQ ID NO: 367 - protein, 73 aa, Artificial sequence
  artificial construct
MGSWDEFAWRLDVIFARLGALGGSEAELAAFEKEIAAFESELQAYKGKGNPEVEELRKNAAQIRDGLQAYRHN

SEQ ID NO: 368 - protein, 73 aa, Artificial sequence
  artificial construct
MGSWDEFYYRLEAIEMRLGALGGSEAELAAFEKEIAAFESELQAYKGKGNPEVEELRHYAAQIRHMLQAYRHN

SEQ ID NO: 369 - protein, 73 aa, Artificial sequence
  artificial construct
MGSWEEFYDRLEAIYNRLGALGGSEAELAAFEKEIAAFESELQAYKGKGNPEVEVLREYAADIREMLQAYRHN

SEQ ID NO: 370 - protein, 73 aa, Artificial sequence
  artificial construct
MGSWDEFGRRLYAIEWQLYALGGEEAELAAFEKEIAAFESELQAYKGKGNPEVEALRKEAAVIRENLQAYRHN

SEQ ID NO: 371 - protein, 73 aa, Artificial sequence
  artificial construct
MGSWDEFGRRLYAIEWQLYALGGTEAELAAFEKEIAAFESELQAYKGKGNPEVEALRKEAAVIRENLQAYRHN

SEQ ID NO: 372 - protein, 73 aa, Artificial sequence
  artificial construct
MGSWDEFGRRLYAIETQLYALGGEEAELAAFEKEIAAFESELQAYKGKGNPEVEKLREIAAVIRENLQAYRHN

SEQ ID NO: 373 - protein, 73 aa, Artificial sequence
  artificial construct
MGSWDEFGRRLYAIEWQLYALGGEEAELAAFEKEIAAFESELQAYKGKGNPEVEKLREIAAVIRENLQAYRHN

SEQ ID NO: 374 - protein, 73 aa, Artificial sequence
  artificial construct
MGSWDEFGRRLYAIKWQLYALGGEEAELAAFEKEIAAFESELQAYKGKGNPEVEKLREIAAVIRENLQAYRHN

SEQ ID NO: 375 - protein, 73 aa, Artificial sequence
  artificial construct
MGSWDEFGRRLYAIEWQLYALGGEEAELAAFEKEIAAFESELQAYKGKGNPEVEKLRKIAAVIRENLQAYRHN

SEQ ID NO: 376 - protein, 73 aa, Artificial sequence
  artificial construct
MGSWDEFGRRLYAIEWQLYALGGGEAELAAFEKEIAAFESELQAYKGKGNPEVEKLREIAAVIRENLQAYRHN

SEQ ID NO: 377 - protein, 73 aa, Artificial sequence
  artificial construct
MGSWDEFGRRLYAIEWQLYALGGTEAELAAFEKEIAAFESELQAYKGKGNPEVEKLREIAAVIRENLQAYRHN

SEQ ID NO: 378 - protein, 73 aa, Artificial sequence
  artificial construct
MGSWDEFGRRLYAIEWQLYALGGGEAELAAFEKEIAAFESELQAYKGKGNPEVEKLREIAAVIRSNLQAYRHN

SEQ ID NO: 379 - protein, 73 aa, Artificial sequence
  artificial construct
MGSWDEFGRRLYAIEWQLYALGGTEAELAAFEKEIAAFESELQAYKGKGNPEVEKLREIAAVIRSNLQAYRHN

SEQ ID NO: 380 - protein, 73 aa, Artificial sequence
  artificial construct
MGSWDEFGRRLYAIEWQLYALGGEEAELAAFEKEIAAFESELQAYKGKGNPEVEKLREIAAVIRSNLQAYRHN

SEQ ID NO: 381 - protein, 73 aa, Artificial sequence
  artificial construct
MGSWDEFGRRLAAIEWQLYALGGEEAELAAFEKEIAAFESELQAYKGKGNPEVEKLREIAAVIRENLQAYRHN

SEQ ID NO: 382 - protein, 73 aa, Artificial sequence
  artificial construct
MGSWDEFGRRLYAIEWQLYALGGEEAELAAFEKEIAAFESELQAYKGKGNPEVEALREIAAVIRENLQAYRHN

SEQ ID NO: 383 - protein, 73 aa, Artificial sequence
  artificial construct
MGSWDEFGRRLYAIEWQLYALGGEEAELAAFEKEIAAFESELQAYKGKGNPEVEKLREEAAVIRENLQAYRHN

SEQ ID NO: 384 - protein, 73 aa, Artificial sequence
  artificial construct
MGSWDEFGRRLYAIEWRLYALGGSEAELAAFEKEIAAFESELQAYKGKGSPEVEKLREIAAVIRSNLQAYRHN

SEQ ID NO: 385 - protein, 73 aa, Artificial sequence
  artificial construct
MGSWDEFGRRLYAIEWRLYALGGSEAELAAFEKEIAAFESELQAYKGKGNPEVEKLREIAAVIRSNLQAYRHN

SEQ ID NO: 386 - protein, 73 aa, Artificial sequence
  artificial construct
MGSWDEFGRRLYAIEWRLYALGGEEAELAAFEKEIAAFESELQAYKGKGNPEVEKLREIAAVIRSNLQAYRHN

SEQ ID NO: 387 - protein, 73 aa, Artificial sequence
  artificial construct
MGSWDEFGRRLYAIEWQLYALGGSEAELAAFEKEIAAFESELQAYKGKGNPEVEKLREIAAVIRSNLQAYRHN

SEQ ID NO: 388 - protein, 73 aa, Artificial sequence
  artificial construct
MGSWDEFSRRLYAIEWRLYALGGSEAELAAFEKEIAAFESELQAYKGKGNPEVEKLREIAAVIRSNLQAYRHN

SEQ ID NO: 389 - protein, 73 aa, Artificial sequence
  artificial construct
MGSWDEFGRRLYAIEWRLYALGGSEAELAAFEKEIAAFESELQAYKGKGNPEVEKLREIAAVIRENLQAYRHN

SEQ ID NO: 390 - protein, 73 aa, Artificial sequence
  artificial construct
MGSWDEFGRRLAAIKTQLAALGGEEAELAAFEKEIAAFESELQAYKGKGNPEVEKLREIAAVIRENLQAYRHN

SEQ ID NO: 391 - protein, 73 aa, Artificial sequence
  artificial construct
MGSWDEFGRRLAAIKTQLAALGGTEAELAAFEKEIAAFESELQAYKGKGNPEVEKLREIAAVIRENLQAYRHN

SEQ ID NO: 392 - protein, 73 aa, Artificial sequence
  artificial construct
MGSWDEFGRRLAAIKTQLAALGGEEAELAAFEKEIAAFESELQAYKGKGNPEVEALRKEAAVIRENLQAYRHN

SEQ ID NO: 393 - protein, 73 aa, Artificial sequence
  artificial construct
MGSWDEFGRRLAAIKTQLAALGGTEAELAAFEKEIAAFESELQAYKGKGNPEVEALRKEAAVIRENLQAYRHN

SEQ ID NO: 394 - protein, 73 aa, Artificial sequence
  artificial construct
MGSWDEFEQRLIAIEERLFALGGSEAELAAFEKEIAAFESELQAYKGKGNPEVEWLREEAAVIRKYLQAYRHN

SEQ ID NO: 395 - protein, 73 aa, Artificial sequence
  artificial construct
MGSWVEFDQRLGAIWDRLVALGGSEAELAAFEKEIAAFESELQAYKGKGNPEVEHLRQGAAVIRDDLQAYRHN

SEQ ID NO: 396 - protein, 73 aa, Artificial sequence
  artificial construct
MGSWVEFDMRLSAIWERLIALGGSEAELAAFEKEIAAFESELQAYKGKGNPEVEWLREDAAEIREFLQAYRHN

SEQ ID NO: 397 - protein, 73 aa, Artificial sequence
  artificial construct
MGSWVEFDQRLDAIYERLYALGGSEAELAAFEKEIAAFESELQAYKGKGNPEVEWLRDEAAEIREHLQAYRHN

SEQ ID NO: 398 - protein, 73 aa, Artificial sequence
  artificial construct
MGSWHEFDQRLWAIEERLWALGGSEAELAAFEKEIAAFESELQAYKGKGNPEVETLRLYAALIRHDLQAYRHN

SEQ ID NO: 399 - protein, 73 aa, Artificial sequence
  artificial construct
MGSWVEFWDRLDAIEGRLWALGGSEAELAAFEKEIAAFESELQAYKGKGNPEVEDLRWLAAEIRADLQAYRHN

SEQ ID NO: 400 - protein, 73 aa, Artificial sequence
  artificial construct
MGSWVEFYSRLDAIEDRLWALGGSEAELAAFEKEIAAFESELQAYKGKGNPEVEWLRIAAASIREDLQAYRHN

SEQ ID NO: 401 - protein, 73 aa, Artificial sequence
  artificial construct
MGSWYEFYERLDAIEERLWALGGSEAELAAFEKEIAAFESELQAYKGKGNPEVEVLRDWAAWIREDLQAYRHN

SEQ ID NO: 402 - protein, 73 aa, Artificial sequence
  artificial construct
MGSWFEFDDRLWAIENRLWALGGSEAELAAFEKEIAAFESELQAYKGKGNPEVEVLRDNAAWIREILQAYRHN

SEQ ID NO: 403 - protein, 73 aa, Artificial sequence
  artificial construct
MGSWYEFWDRLDALEDRLWALGGSEAELAAFEKEIAAFESELQAYKGKGNPEVEYLRDSAAFIREELQAYRHN

SEQ ID NO: 404 - protein, 73 aa, Artificial sequence
  artificial construct
MGSWMEFVDRLDAIESRLWALGGSEAELAAFEKEIAAFESELQAYKGKGNPEVEWLRIEAAFIREELQAYRHN

SEQ ID NO: 405 - protein, 73 aa, Artificial sequence
  artificial construct
MGSWDEFVDRLWAIEERLWALGGSEAELAAFEKEIAAFESELQAYKGKGNPEVEELRIQAAIIREALQAYRHN

SEQ ID NO: 406 - protein, 73 aa, Artificial sequence
  artificial construct
MGSWFEFNYRLGAIEDRLWALGGSEAELAAFEKEIAAFESELQAYKGKGNPEVEMLRQIAAEIREFLQAYRHN

SEQ ID NO: 407 - protein, 73 aa, Artificial sequence
  artificial construct
MGSWEEFFTRLDAINERLEALGGSEAELAAFEKEIAAFESELQAYKGKGNPEVEMLRYEAAEIRHMLQAYRHN

SEQ ID NO: 408 - protein, 73 aa, Artificial sequence
  artificial construct
MGSWYEFSNRLDAIGERLWALGGSEAELAAFEKEIAAFESELQAYKGKGNPEVEILRHQAAEIRWFLQAYRHN

SEQ ID NO: 409 - protein, 73 aa, Artificial sequence
  artificial construct
MGSWYEFWGRLDAIEERLWALGGSEAELAAFEKEIAAFESELQAYKGRGNPEVEMLREDAAEIRGQLQAYRHN

SEQ ID NO: 410 - protein, 73 aa, Artificial sequence
  artificial construct
MGSWVEFWDRLWAIDYRLFALGGSEAELAAFEKEIAAFESELQAYKGKGNPEVEALRDEAAWIREELQAYRHN

SEQ ID NO: 411 - protein, 73 aa, Artificial sequence
  artificial construct
MGSWVEFVDRLWAIDERLDALGGSEAELAAFEKEIAAFESELQAYKGKGNPEVEFLRTWAAWIREDLQAYRHN

SEQ ID NO: 412 - protein, 73 aa, Artificial sequence
  artificial construct
MGSWFEFWDRLEAIWERLDALGGSEAELAAFEKEIAAFESELQAYKGKGNPEVEELRREAAIIREDLQAYRHN

SEQ ID NO: 413 - protein, 73 aa, Artificial sequence
  artificial construct
MGSWFEFEDRLEAIYQRLDALGGSEAELAAFEKEIAAFESELQAYKGKGNPEVEWLRDEAAWIRSDLQAYRHN

SEQ ID NO: 414 - protein, 73 aa, Artificial sequence
  artificial construct
MGSWFEFHDRLWAIDERLWALGGSEAELAAFEKEIAAFESELQAYKGKGNPEVEILREEAADIRLDLQAYRHN

SEQ ID NO: 415 - protein, 73 aa, Artificial sequence
  artificial construct
MGSWYEFEDRLWAIDNRLWALGGSEAELAAFEKEIAAFESELQAYKGKGNPEVEELRVHAADIRDDLQAYRHN

SEQ ID NO: 416 - protein, 73 aa, Artificial sequence
  artificial construct
MGSWFEFQDRLWAIDNRLWALGGSEAELAAFEKEIAAFESELQAYKGKGNPEVEELRDHAAMIRWELQAYRHN

SEQ ID NO: 417 - protein, 73 aa, Artificial sequence
  artificial construct
MGSWDEFEERLFAIDERLWALGGSEAELAAFEKEIAAFESELQAYKGKGNPEVEALRYLAADIREELQAYRHN

SEQ ID NO: 418 - protein, 73 aa, Artificial sequence
  artificial construct
MGSWEEFWERLDAIDTRLWALGGSEAELAAFEKEIAAFESELQAYKGKGNPEVEVLRNDAADIREPLQAYRHN

SEQ ID NO: 419 - protein, 73 aa, Artificial sequence
  artificial construct
MGSWMEFWERLEAIDMRLWALGGSEAELAAFEKEIAAFESELQAYKGKGNPEVEYLRDDAAVIRDDLQAYRHN

SEQ ID NO: 420 - protein, 73 aa, Artificial sequence
  artificial construct
MGSWLEFMWRLDAIDERLWALGGSEAELAAFEKEIAAFESELQAYKGKGNPEVELLREMAAAIRDDLQAYRHN

SEQ ID NO: 421 - protein, 73 aa, Artificial sequence
  artificial construct
MGSWTEFYNRLDAIDQRLWALGGSEAELAAFEKEIAAFESELQAYKGKGNPEVEMLREYAADIRTDLQAYRHN

SEQ ID NO: 422 - protein, 73 aa, Artificial sequence
  artificial construct
MGSWWEFIWRLEAIEQRLWALGGSEAELAAFEKEIAAFESELQAYKGKGNPEVEVLRSRAADIRTDLQAYRHN

SEQ ID NO: 423 - protein, 73 aa, Artificial sequence
  artificial construct
MGSWSEFYDRLWAIEERLFALGGSEAELAAFEKEIAAFESELQAYKGKGNPEVEYLRYYAAEIREELQAYRHN

SEQ ID NO: 424 - protein, 73 aa, Artificial sequence
  artificial construct
MGSWSEFEDRLWAIDQRLFALGGSEAELAAFEKEIAAFESELQAYKGKGNPEVEWLRAYAADIRWELQAYRHN

SEQ ID NO: 425 - protein, 73 aa, Artificial sequence
  artificial construct
MGSWTEFWERLNAIDERLFALGGSEAELAAFEKEIAAFESELQAYKGKGNPEVEWLRLYAAEIRSELQAYRHN

SEQ ID NO: 426 - protein, 73 aa, Artificial sequence
  artificial construct
MGSWWEFEERLWAIDYRLHALGGSEAELAAFEKEIAAFESELQAYKGKGNPEVEMLRSWAAEIRALLQAYRHN

SEQ ID NO: 427 - protein, 73 aa, Artificial sequence
  artificial construct
MGSWWEFENRLWAIEERLEALGGSEAELAAFEKEIAAFESELQAYKGKGNPEVEMLRNYAAEIRWELQAYRHN

SEQ ID NO: 428 - protein, 73 aa, Artificial sequence
  artificial construct
MGSWVEFEERLWAIDERLGALGGSEAELAAFEKEIAAFESELQAYKGKGNPEVEWLRDWAADIRWWLQAYRHN

SEQ ID NO: 429 - protein, 73 aa, Artificial sequence
  artificial construct
MGSWVEFEERLEAIEERLFALGGSEAELAAFEKEIAAFESELQAYKGKGNPEVEWLRDDAANIRHWLQAYRHN

SEQ ID NO: 430 - protein, 73 aa, Artificial sequence
  artificial construct
MGSWMEFEERLWAIDSRLWALGGSEAELAAFEKEIAAFESELQAYKGKGNPEVEWLRSEAAWIRMELQAYRHN

SEQ ID NO: 431 - protein, 73 aa, Artificial sequence
  artificial construct
MGSWSEFEHRLEAIESRLFALGGSEAELAAFEKEIAAFESELQAYKGKGNPEVEDLRSEAAWIREQLQAYRHN

SEQ ID NO: 432 - protein, 73 aa, Artificial sequence
  artificial construct
MGSWFEFWERLDAIEWRLWALGGSEAELAAFEKEIAAFESELQAYKGKGNPEVEELRSTAADIRRYLQAYRHN

SEQ ID NO: 433 - protein, 73 aa, Artificial sequence
  artificial construct
MGSWFEFWGRLEAIESRLKALGGSEAELAAFEKEIAAFESELQAYKGKGNPEVEELREHAAWIRAYLQAYRHN

SEQ ID NO: 434 - protein, 73 aa, Artificial sequence
  artificial construct
MGSWQEFTMRLDAIYNRLETLGGSEAELAAFEKEIAAFESELQAYKGKGNPEVEWLRQSAANIRSELQAYRHN

SEQ ID NO: 435 - protein, 73 aa, Artificial sequence
  artificial construct
MGSWSEFNMRLDAIYERLTALGGSEAELAAFEKEIAAFESELQAYKGKGNPEVEWLRHSAARIRLELQAYRHN

SEQ ID NO: 436 - protein, 73 aa, Artificial sequence
  artificial construct
MGSWSEFNMRLDAIYERLTALGGSEAELAAFEKEIAAFESELQAYKGKGNPEVEWLRHSAALIRLELQAYRHN

SEQ ID NO: 437 - protein, 73 aa, Artificial sequence
  artificial construct
MGSWIEFNMRLDAIYERLVALGGSEAELAAFEKEIAAFESELQAYKGKGNPEVEWLRKVAANIRLELQAYRHN

SEQ ID NO: 438 - protein, 73 aa, Artificial sequence
  artificial construct
MGSWYEFHHRLDAIYERLLALGGSEAELAAFEKEIAAFESELQAYKGKGNPEVEWLRSSAANIRKELQAYRHN

SEQ ID NO: 439 - protein, 73 aa, Artificial sequence
  artificial construct
MGSWYEFAKRLDAIYERLVALGGSEAELAAFEKEIAAFESELQAYKGKGNPEVEWLRSSAANIREELQAYRHN

SEQ ID NO: 440 - protein, 73 aa, Artificial sequence
  artificial construct
MGSWTEFYVRLDAIYERLDALGGSEAELAAFEKEIAAFESELQAYKGKGNPEVEWLRMVAANIRTELQAYRHN

SEQ ID NO: 441 - protein, 73 aa, Artificial sequence
  artificial construct
MGSWVEFYTRLDAIYGRLDALGGSEAELAAFEKEIAAFESELQAYKGKGNPEVEWLRQVAANIRMELQAYRHN

SEQ ID NO: 442 - protein, 73 aa, Artificial sequence
  artificial construct
MGSWVEFHMRLDAIYERLDALGGSEAELAAFEKEIAAFESELQAYKGKGNPEVEWLRTAAANIRVELQAYRHN

SEQ ID NO: 443 - protein, 73 aa, Artificial sequence
  artificial construct
MGSWYEFAIRLDAIYERLHALGGSEAELAAFEKEIAAFESELQAYKGKGNPEVEYLRVWAANIRTELQAYRHN

SEQ ID NO: 444 - protein, 73 aa, Artificial sequence
  artificial construct
MGSWNEFVIRLDAIYERLLALGGSEAELAAFEKEIAAFESELQAYKGKGNPEVEYLRMAAANIRMELQAYRHN

SEQ ID NO: 445 - protein, 73 aa, Artificial sequence
  artificial construct
MGSWSEFYVRVDAIYARLSALGGSEAELAAFEKEIAAFESELQAYKGKGNPEVEKLRVWAANIRHELQAYRHN

SEQ ID NO: 446 - protein, 73 aa, Artificial sequence
  artificial construct
MGSWSEFHVRLDAIYARLDALGGSEAELAAFEKEIAAFESELQAYKGKGNPEVERLREWAANIRRELQAYRHN

SEQ ID NO: 447 - protein, 73 aa, Artificial sequence
  artificial construct
MGSWVEFHLRLDAIYGRLMALGGSEAELAAFEKEIAAFESELQAYKGKGNPEVENLRVWAANIRNELQAYRHN

SEQ ID NO: 448 - protein, 73 aa, Artificial sequence
  artificial construct
MGSWVEFEMRLDAIVGRLYALGGSEAELAAFEKEIAAFESELQAYKGKGNPEVEKLRRWAANIRSELQAYRHN

SEQ ID NO: 449 - protein, 73 aa, Artificial sequence
  artificial construct
MGSWVEFNIRLDAIYERLYALGGSEAELAAFEKEIAAFESELQAYKGKGNPEVEKLRHWAASIRRELQAYRHN

SEQ ID NO: 450 - protein, 73 aa, Artificial sequence
  artificial construct
MGSWHEFGVRLDAIYDRLMALGGSEAELAAFEKEIAAFESELQAYKGKGNPEVEFLRQAAANIRSELQAYRHN

SEQ ID NO: 451 - protein, 73 aa, Artificial sequence
  artificial construct
MGSWTEFNLRLDAIYDRLMALGGSEAELAAFEKEIAAFESELQAYKGKGNPEVEWLRASAAAIRVELQAYRHN

SEQ ID NO: 452 - protein, 73 aa, Artificial sequence
  artificial construct
MGSWTEFNLRLDAIYGRLSALGGSEAELAAFEKEIAAFESELQAYKGKGNPEVEFLRAAAANIRVELQAYRHN

SEQ ID NO: 453 - protein, 73 aa, Artificial sequence
  artificial construct
MGSWVEFNWRLDAIYDRLVALGGSEAELAAFEKEIAAFESELQAYKGKGNPEVEWLRVSAAKIRGELQAYRHN

SEQ ID NO: 454 - protein, 73 aa, Artificial sequence
  artificial construct
MGSWNEFAWRLDAIYSRLAALGGSEAELAAFEKEIAAFESELQAYKGKGNPEVEWLRVAAANIRYELQAYRHN

SEQ ID NO: 455 - protein, 73 aa, Artificial sequence
  artificial construct
MGSWTEFAWRLDAIYDRLLALGGSEAELAAFEKEIAAFESELQAYKGKGNPEVEWLRHVAANIRRELQAYRHN

SEQ ID NO: 456 - protein, 73 aa, Artificial sequence
  artificial construct
MGSWVEFSIRLDAIYTRLVALGGSEAELAAFEKEIAAFESELQAYKGKGNPEVEMLRKGAANIRKELQAYRHN

SEQ ID NO: 457 - protein, 73 aa, Artificial sequence
  artificial construct
MGSWVEFYIRLDAIYVRLMALGGSEAELAAFEKEIAAFESELQAYKGKGNPEVEKLRSYAANIRQELQAYRHN

SEQ ID NO: 458 - protein, 73 aa, Artificial sequence
  artificial construct
MGSWYEFSMRLDAIYDRLMALGGSEAELAAFEKEIAAFESELQAYKGKGNPEVEQLRGYAANIRNELQAYRHN

SEQ ID NO: 459 - protein, 73 aa, Artificial sequence
  artificial construct
MGSWVEFIYRLDAIYDRLEALGGSEAELAAFEKEIAAFESELQAYKGKGNPEVEVLRRYAANIRNELQAYRHN

SEQ ID NO: 460 - protein, 73 aa, Artificial sequence
  artificial construct
MGSWIEFEVRLDAIYNRLAALGGSEAELAAFEKEIAAFESELQAYKGKGNPEVERLRRYAANIRHELQAYRHN

SEQ ID NO: 461 - protein, 73 aa, Artificial sequence
  artificial construct
MGSWFEFYDRLDAIYMRLIALGGSEAELAAFEKEIAAFESELQAYKGKGNPEVEVLRRYAANIRAELQAYRHN

SEQ ID NO: 462 - protein, 73 aa, Artificial sequence
  artificial construct
MGSWFEFYMRLDAIYDRLTALGGSEAELAAFEKEIAAFESELQAYKGKGNPEVERLRTFAANIRKELQAYRHN

SEQ ID NO: 463 - protein, 73 aa, Artificial sequence
  artificial construct
MGSWYEFDYRLDAIYDRLAALGGSEAELAAFEKEIAAFESELQAYKGKGNPEVERLRKWAANIREELQAYRHN

SEQ ID NO: 464 - protein, 73 aa, Artificial sequence
  artificial construct
MGSWSEFYLRLDAIYDRLDALGGSEAELAAFEKEIAAFESELQAYKGKGNPEVEWLRKTAANIREELQAYRHN

SEQ ID NO: 465 - protein, 73 aa, Artificial sequence
  artificial construct
MGSWFEFYERLDAINWRLFALGGSEAELAAFEKEIAAFESELQAYKGKGNPEVEALRGEAAAIREDLQAYRHN

SEQ ID NO: 466 - protein, 73 aa, Artificial sequence
  artificial construct
MGSWNEFEDRLDAIWWRLFALGGSEAELAAFEKEIAAFESELQAYKGKGNPEVEALRVEAAFIRTMLQAYRHN

SEQ ID NO: 467 - protein, 73 aa, Artificial sequence
  artificial construct
MGSWFYFKDDLADINYMLEALGGSEAELAMFEDDIAGFELTLLKYKGKGNPEVEALRKEAAAIRDELQAYRHN

SEQ ID NO: 468 - protein, 73 aa, Artificial sequence
  artificial construct
MGSWHFFKDDLAWIKNELEALGGSEAELAMFEDDIAMFETMLQSYKGKGNPEVEALRKEAAAIRDELQAYRHN

SEQ ID NO: 469 - protein, 73 aa, Artificial sequence
  artificial construct
MGSWHWFKTDLADIKEELEALGGSEAELAMFEDDIAEFEEFLQMYKGKGNPEVEALRKEAAAIRDELQAYRHN

SEQ ID NO: 470 - protein, 73 aa, Artificial sequence
  artificial construct
MGSWWLFKDDLAEIKYWLEALGGSEAELAFFEDDIAEFERGLQIYKGKGNPEVEALRKEAAAIRDELQAYRHN

SEQ ID NO: 471 - protein, 73 aa, Artificial sequence
  artificial construct
MGSWYEFKDDLAEIKEWLEALGGSEAELAFFELDIADFEWLLQLYKGKGNPEVEALRKEAAAIRDELQAYRHN

SEQ ID NO: 472 - protein, 73 aa, Artificial sequence
  artificial construct
MGSWQWFKDDLAYIKETLEALGGSEAELALFEDMIADFEFELQWYKGKGNPEVEALRKEAAAIRDELQAYRHN

SEQ ID NO: 473 - protein, 73 aa, Artificial sequence
  artificial construct
MGSWILFKDDLAWIKETLEALGGSEAELAFFEDNIADFEEQLQGYKGKGNPEVEALRKEAAAIRDELQAYRHN

SEQ ID NO: 474 - protein, 73 aa, Artificial sequence
  artificial construct
MGSWIVFKDDLADIKRWLEALGGSEAELAMFEDEIADFEWQLQDYKGKGNPEVEALRKEAAAIRDELQAYRHN

SEQ ID NO: 475 - protein, 73 aa, Artificial sequence
  artificial construct
MGSWGHFKQDLAWIKDTLEALGGSEAELAFFEDDIAMFEMELQDYKGKGNPEVEALRKEAAAIRDELQAYRHN

SEQ ID NO: 476 - protein, 73 aa, Artificial sequence
  artificial construct
MGSWGYFKDDLAWIKGELEALGGSEAELAEFEWFIAVFEEDLQVYKGKGNPEVEALRKEAAAIRDELQAYRHN

SEQ ID NO: 477 - protein, 73 aa, Artificial sequence
  artificial construct
MGSWYWFKDDLAEIKGLLEALGGSEAELAEFEDEIAVFEQELQEYKGKGNPEVEALRKEAAAIRDELQAYRHN

SEQ ID NO: 478 - protein, 73 aa, Artificial sequence
  artificial construct
MGSWMFFKEDLADIKWALEALGGSEAELAFFEEEIALFEQHLQQYKGKGNPEVEALRKEAAAIRDELQAYRHN

SEQ ID NO: 479 - protein, 73 aa, Artificial sequence
  artificial construct
MGSWTFFKEDLAGIKWELEALGGSEAELAWFEDEIALFEEELQEYKGKGNPEVEALRKEAAAIRDELQAYRHN

SEQ ID NO: 480 - protein, 73 aa, Artificial sequence
  artificial construct
MGSWVFFKDDLADIKDELEALGGSEAELAFFEIAIALFEWELQEYKGKGNPEVEALRKEAAAIRDELQAYRHN

SEQ ID NO: 481 - protein, 73 aa, Artificial sequence
  artificial construct
MGSWTFFKNDLAEIKDWLEALGGSEAELADFEWDIAEFEYSLQEYKGKGNPEVEALRKEAAAIRDELQAYRHN

SEQ ID NO: 482 - protein, 73 aa, Artificial sequence
  artificial construct
MGSWTYFKDDLADIKQWLEALGGSEAELAFFEIEIAEFEEELQEYKGKGNPEVEALRKEAAAIRDELQAYRHN

SEQ ID NO: 483 - protein, 73 aa, Artificial sequence
  artificial construct
MGSWTVFKYDLADIKWWLEALGGSEAELADFEEEIAEFEEELQEYKGKGNPEVEALRKEAAAIRDELQAYRHN

SEQ ID NO: 484 - protein, 73 aa, Artificial sequence
  artificial construct
MGSWYWFKQDLAHIKSMLEALGGSEAELAWFEEDIADFESELQEYKGKGNPEVEALRKEAAAIRDELQAYRHN

SEQ ID NO: 485 - protein, 73 aa, Artificial sequence
  artificial construct
MGSWTFFKWDLADIKANLEALGGSEAELAWFEEDLAGFEAELQEYKGKGNPEVEALRKEAAAIRDELQAYRHN

SEQ ID NO: 486 - protein, 73 aa, Artificial sequence
  artificial construct
MGSWSFFKEELANIQVYLEALGGSEAELAWFEEDIADFEEDLQHYKGKGNPEVEALRKEAAAIRDELQAYRHN

SEQ ID NO: 487 - protein, 73 aa, Artificial sequence
  artificial construct
MGSWEFFKYELADIKDELEALGGSEAELAWFEEDIATFEEWLQGYKGKGNPEVEALRKEAAAIRDELQAYRHN

SEQ ID NO: 488 - protein, 73 aa, Artificial sequence
  artificial construct
MGSWQTFKDELAHIKWELEALGGSEAELAWFEWDIANFEEELQEYKGKGNPEVEALRKEAAAIRDELQAYRHN

SEQ ID NO: 489 - protein, 73 aa, Artificial sequence
  artificial construct
MGSWYWFKEELAFIKWELEALGGSEAELALFEEDIAYFEEMLQEYKGKGNPEVEALRKEAAAIRDELQAYRHN

SEQ ID NO: 490 - protein, 73 aa, Artificial sequence
  artificial construct
MGSWNSFKDELAEIKAELEALGGSEAELAFFEEDIAWFEEHLQQYKGKGNPEVEALRKEAAAIRDELQAYRHN

SEQ ID NO: 491 - protein, 73 aa, Artificial sequence
  artificial construct
MGSWDLFKWELAEIKLGLEALGGSEAELAEFEYDIAWFEEDLQDYKGKGNPEVEALRKEAAAIRDELQAYRHN

SEQ ID NO: 492 - protein, 73 aa, Artificial sequence
  artificial construct
MGSWIFFKQDLAEIKLNLEALGGSEAELAWFEDDIAWFESHLQDYKGKGNPEVEALRKEAAAIRDELQAYRHN

SEQ ID NO: 493 - protein, 73 aa, Artificial sequence
  artificial construct
MGSWHLFKWTLAEIKYELEALGGSEAELAWFEDDIATFEEELQWYKGKGNPEVEALRKEAAAIRDELQAYRHN

SEQ ID NO: 494 - protein, 73 aa, Artificial sequence
  artificial construct
MGSWVTFKDELADIKDFLEALGGSEAELAFFEVDIAEFEAELQFYKGKGNPEVEALRKEAAAIRDELQAYRHN

SEQ ID NO: 495 - protein, 73 aa, Artificial sequence
  artificial construct
MGSWVYFKDELADIKDFLEALGGSEAELAEFEEDIATFEYDLQWYKGKGNPEVEALRKEAAAIRDELQAYRHN

SEQ ID NO: 496 - protein, 73 aa, Artificial sequence
  artificial construct
MGSWETFKYELAEIKDYLEALGGSEAELAWFEDDIAEFEFELQYYKGKGNPEVEALRKEAAAIRDELQAYRHN

SEQ ID NO: 497 - protein, 73 aa, Artificial sequence
  artificial construct
MGSWNTFKYELAEIKHFLEALGGSEAELAMFEDDIAMFEWELQEYKGKGNPEVEALRKEAAAIRDELQAYRHN

SEQ ID NO: 498 - protein, 73 aa, Artificial sequence
  artificial construct
MGSWYVFKDELAEIKQFLEALGGSEAELAWFEDDIAEFETQLQHYKGKGNPEVEALRKEAAAIRDELQAYRHN

SEQ ID NO: 499 - protein, 73 aa, Artificial sequence
  artificial construct
MGSWIFFKEQLAIIKWELEALGGSEAELAWFEDDIAAFEDDLQFYKGQGNPEVEALRKEAAAIRDELQAYRHN

SEQ ID NO: 500 - protein, 73 aa, Artificial sequence
  artificial construct
MGSWEFFKEVLAEIKYDLEALGGSEAELAWFETDIAGFEIDLQVYKGKGNPEVEALRKEAAAIRDELQAYRHN

SEQ ID NO: 501 - protein, 73 aa, Artificial sequence
  artificial construct
MGSWVFFKEDLATIKNDLEALGGSEAELAWFEMMIADFEADLQYYKGKGNPEVEALRKEAAAIRDELQAYRHN

SEQ ID NO: 502 - protein, 73 aa, Artificial sequence
  artificial construct
MGSWEEFKEDLAEIKVWLEALGGSEAELAWFEMGIADFEDGLQFYKGKGNPEVEALRKEAAAIRDELQAYRHN

SEQ ID NO: 503 - protein, 73 aa, Artificial sequence
  artificial construct
MGSWHWFKEDLANIKDWLEALGGSEAELAWFEDNIADFEGDLQVYKGKGNPEVEALRKEAAAIRDELQAYRHN

SEQ ID NO: 504 - protein, 73 aa, Artificial sequence
  artificial construct
MGSWFWFKEDLAFIKEDLEALGGSEAELAWFEDGIAFFEWDLQDYKGKGNPEVEALRKEAAAIRDELQAYRHN

SEQ ID NO: 505 - protein, 73 aa, Artificial sequence
  artificial construct
MGSWQWFKEDLAEIKHDLEALGGSEAELAWFEDFIAQFEFDLQWYKGKGNPEVEALRKEAAAIRDELQAYRHN

SEQ ID NO: 506 - protein, 73 aa, Artificial sequence
  artificial construct
MGSWHWFKEDLAIIKQDLEALGGSEAELATFEQWIAEFEWDLQEYKGKGNPEVEALRKEAAAIRDELQAYRHN

SEQ ID NO: 507 - protein, 73 aa, Artificial sequence
  artificial construct
MGSWNWFKEDLAIIKMDLEALGGSEAELAWFEHNIAGFEFELQGYKGKGNPEVEALRKEAAAIRDELQAYRHN

SEQ ID NO: 508 - protein, 73 aa, Artificial sequence
  artificial construct
MGSWSWFKEDLAEIKMELEALGGSEAELAYFEWYIAEFEFQLQHYKGKGNPEVEALRKEAAAIRDELQAYRHN

SEQ ID NO: 509 - protein, 73 aa, Artificial sequence
  artificial construct
MGSWSWFKQDLADIKIQLEALGGSEAELAWFEWDIAEFEFELQDYKGKGNPEVEALRKEAAAIRDELQAYRHN

SEQ ID NO: 510 - protein, 73 aa, Artificial sequence
  artificial construct
MGSWSWFKEDLADIKFELEALGGSEAELAWFELDIADFEQALQQYKGKGNPEVEALRKEAAAIRDELQAYRHN

SEQ ID NO: 511 - protein, 73 aa, Artificial sequence
  artificial construct
MGSWSWFKEDLASIKAVLEALGGSEAELAFFESDIAEFEQELQYYKGKGNPEVEALRKEAAAIRDELQAYRHN

SEQ ID NO: 512 - protein, 73 aa, Artificial sequence
  artificial construct
MGSWWEFKEDLAEIKWFLEALGGSEAELAWFEHDIAKFEFELQYYKGKGNPEVEALRKEAAAIRDELQAYRHN

SEQ ID NO: 513 - protein, 73 aa, Artificial sequence
  artificial construct
MGSWEWFKSDLASIKWELEALGGSEAELAWFEHDIAEFEEDLQWYKGKGNPEVEALRKEAAAIRDELQAYRHN

SEQ ID NO: 514 - protein, 73 aa, Artificial sequence
  artificial construct
MGSWNEFKDDLAMIKMTLEALGGSEAELAWFEHDIAEFEDDLQWYKGKGNPEVEALRKEAAAIRDELQAYRHN

SEQ ID NO: 515 - protein, 73 aa, Artificial sequence
  artificial construct
MGSWTFFKDDLAEIKWMLEALGGSEAELAWFESDIAYFEDELQWYKGKGNPEVEALRKEAAAIRDELQAYRHN

SEQ ID NO: 516 - protein, 73 aa, Artificial sequence
  artificial construct
MGSWSDFKDDLAEIKMILEALGGSEAELAYFENDIAWFEDDLQEYKGKGNPEVEALRKEAAAIRDELQAYRHN

SEQ ID NO: 517 - protein, 73 aa, Artificial sequence
  artificial construct
MGSWSMFKDDLAEIKASLEALGGSEAELAWFEDDIAWFEDDLQHYKGKGNPEVEALRKEAAAIRDELQAYRHN

SEQ ID NO: 518 - protein, 73 aa, Artificial sequence
  artificial construct
MGSWQYFKDDLAEIKMVLEALGGSEAELAWFEADIAMFEDDLQIYKGKGNPEVEALRKEAAAIRDELQAYRHN

SEQ ID NO: 519 - protein, 73 aa, Artificial sequence
  artificial construct
MGSWSFFKDDLAEIKYFLEALGGSEAELAMFEQTIAEFEYDLQDYKGKGNPEVEALRKEAAAIRDELQAYRHN

SEQ ID NO: 520 - protein, 73 aa, Artificial sequence
  artificial construct
MGSWMEFKEELAEIKYILEALGGSEAELAWFEQSIADFEYDLQDYKGKGNPEVEALRKEAAAIRDELQAYRHN

SEQ ID NO: 521 - protein, 73 aa, Artificial sequence
  artificial construct
MGSWAWFKEDLAEIKVFLEALGGSEAELAEFEVSIADFEYELQDYKGKGNPEVEALRKEAAAIRDELQAYRHN

SEQ ID NO: 522 - protein, 73 aa, Artificial sequence
  artificial construct
MGSWYEFKFDLAEIKEQLEALGGSEAELALFEDDIAFFEYDLQNYKGKGNPEVEALRKEAAAIRDELQAYRHN

SEQ ID NO: 523 - protein, 73 aa, Artificial sequence
  artificial construct
MGSWYDFKYDLAEIKMDLEALGGSEAELAQFEFDIAFFEEELQDYKGKGNPEVEALRKEAAAIRDELQAYRHN

SEQ ID NO: 524 - protein, 73 aa, Artificial sequence
  artificial construct
MGSWYIFKEDLAEIKEELEALGGSEAELAYFEEEIALFEMELQWYKGKGNPEVEALRKEAAAIRDELQAYRHN

SEQ ID NO: 525 - protein, 73 aa, Artificial sequence
  artificial construct
MGSWVLFKEELAYIKFELEALGGSEAELALFENVIAIFESNLQNYKGKGNPEVEALRKEAAAIRDELQAYRHN

SEQ ID NO: 526 - protein, 73 aa, Artificial sequence
  artificial construct
MGSWQDFKEDLAWIKYELEALGGSEAELAFFEYDIAIFENNLQHYKGKGNPEVEALRKEAAAIRDELQAYRHN

SEQ ID NO: 527 - protein, 73 aa, Artificial sequence
  artificial construct
MGSWDHFKNDLAWIKKHLEALGGSEAELAEFEAVIAYFELYLQGYKGKGNPEVEALRKEAAAIRDELQAYRHN

SEQ ID NO: 528 - protein, 73 aa, Artificial sequence
  artificial construct
MGSWYDFKEDLADIKWMLEALGGSEAELAEFENVIAYFENDLQEYKGKGNPEVEALRKEAAAIRDELQAYRHN

SEQ ID NO: 529 - protein, 73 aa, Artificial sequence
  artificial construct
MGSWYMFKEELADIKWYLEALGGSEAELAWFEDDIAGFEWDLQAYKGKGNPEVEALRKEAAAIRDELQAYRHN

SEQ ID NO: 530 - protein, 73 aa, Artificial sequence
  artificial construct
MGSWYYFKDELADIKWDLEALGGSEAELAWFEMLIAQFELDLQWYKGKGNPEVEALRKEAAAIRDELQAYRHN

SEQ ID NO: 531 - protein, 73 aa, Artificial sequence
  artificial construct
MGSWMYFKDTLADIKWYLEALGGSEAELAFFEDWIAEFEDDLQVYKGKGNPEVEALRKEAAAIRDELQAYRHN

SEQ ID NO: 532 - protein, 73 aa, Artificial sequence
  artificial construct
MGSWYQFKHDLADIKYGLEALGGSEAELAWFEDDIADFELDLQYYKGKGNPEVEALRKEAAAIRDELQAYRHN

SEQ ID NO: 533 - protein, 73 aa, Artificial sequence
  artificial construct
MGSWYVFKDDLADIKYMLEALGGSEAELAWFEWEIANFEFDLQYYKGKGNPEVEALRKEAAAIRDELQAYRHN

SEQ ID NO: 534 - protein, 73 aa, Artificial sequence
  artificial construct
MGSWNFFKYDLADIMAYLEALGGSEAELAFFEDEIANFEHDLQKYKGKGNPEVEALRKEAAAIRDELQAYRHN

SEQ ID NO: 535 - protein, 73 aa, Artificial sequence
  artificial construct
MGSWHWFKIVLADIKDGLEALGGSEAELAYFETTIADFEMDLQHYKGKGNPEVEALRKEAAAIRDELQAYRHN

SEQ ID NO: 536 - protein, 73 aa, Artificial sequence
  artificial construct
MGSWHWFKIVLADIKDGLEALGGSEAELAYFETTIADFEMDLHHYKGKGNPEVEALRKEAAAIRDELQAYRHN

SEQ ID NO: 537 - protein, 73 aa, Artificial sequence
  artificial construct
MGSWFMFKEELADIKDWLEALGGSEAELASFESYIAWFEQDLQWYKGKGNPEVEALRKEAAAIRDELQAYRHN

SEQ ID NO: 538 - protein, 73 aa, Artificial sequence
  artificial construct
MGSWFMFKQELAWIKEDLEALGGSEAELADFEWDIAEFEWDLQYYKGKGNPEVEALRKEAAAIRDELQAYRHN

SEQ ID NO: 539 - protein, 73 aa, Artificial sequence
  artificial construct
MGSWQIFKGELAYIKQYLEALGGSEAELAFFEFDIAEFEEDLQYYKGKGNPEVEALRKEAAAIRDELQAYRHN

SEQ ID NO: 540 - protein, 73 aa, Artificial sequence
  artificial construct
MGSWDFFKEELAEIKHYLEALGGSEAELAFFEFWIADFEQDLQEYKGKGNPEVEALRKEAAAIRDELQAYRHN

SEQ ID NO: 541 - protein, 73 aa, Artificial sequence
  artificial construct
MGSWFNFKEELAVIKFQLEALGGSEAELAFFEWVIADFEDDLQEYKGKGNPEVEALRKEAAAIRDELQAYRHN

SEQ ID NO: 542 - protein, 73 aa, Artificial sequence
  artificial construct
MGSWYQFKTELAWIKDDLEALGGSEAELAWFEWVIADFEDDLQFYKGKGNPEVEALRKEAAAIRDELQAYRHN

SEQ ID NO: 543 - protein, 73 aa, Artificial sequence
  artificial construct
MGSWFEFKDYLADIKWDLEALGGSEAELAIFEHDIAYFEHNLQQYKGKGNPEVEALRKEAAAIRDELQAYRHN

SEQ ID NO: 544 - protein, 73 aa, Artificial sequence
  artificial construct
MGSWVRFKDFLADIKMDLEALGGSEAELADFEYHIAEFEHNLQEYKGKGNPEVEALRKEAAAIRDELQAYRHN

SEQ ID NO: 545 - protein, 73 aa, Artificial sequence
  artificial construct
MGSWWLFKEQLALIKYNLEALGGSEAELADFESWIAEFEHQLQEYKGKGNPEVEALRKEAAAIRDELQAYRHN

SEQ ID NO: 546 - protein, 73 aa, Artificial sequence
  artificial construct
MGSWHVFKTELADIKFYLEALGGSEAELAMFELWIAEFEHELQDYKGKGNPEVEALRKEAAAIRDELQAYRHN

SEQ ID NO: 547 - protein, 73 aa, Artificial sequence
  artificial construct
MGSWIWFKDWLADIKDLLEALGGSEAELAEFEYDIALFEDQLQAYKGKGNPEVEALRKEAAAIRDELQAYRHN

SEQ ID NO: 548 - protein, 73 aa, Artificial sequence
  artificial construct
MGSWGWFKHELAFIKADLEALGGSEAELAWFEEEIAEFEYELQFYKGKGNPEVEALRKEAAAIRDELQAYRHN

SEQ ID NO: 549 - protein, 73 aa, Artificial sequence
  artificial construct
MGSWTWFKDNLAWIKEDLEALGGSEAELAWFELEIASFETALQDYKGKGNPEVEALRKEAAAIRDELQAYRHN

SEQ ID NO: 550 - protein, 73 aa, Artificial sequence
  artificial construct
MGSWTYFKNDLAGIKEDLEALGGSEAELAQFEFEIAEFEWLLQDYKGKGNPEVEALRKEAAAIRDELQAYRHN

SEQ ID NO: 551 - protein, 73 aa, Artificial sequence
  artificial construct
MGSWTWFKWDLADIKGDLEALGGSEAELAFFEEEIAEFEWRLQDYKGKGNPEVEALRKEAAAIRDELQAYRHN

SEQ ID NO: 552 - protein, 73 aa, Artificial sequence
  artificial construct
MGSWLYFKEYLADIKSDLEALGGSEAELAWFEYEIADFEEQLQYYKGKGNPEVEALRKEAAAIRDELQAYRHN

SEQ ID NO: 553 - protein, 73 aa, Artificial sequence
  artificial construct
MGSWHWFKEELAEIKEDLVALGGSEAELAWFEYDIAMFELSLQNYKGKGNPEVEALRKEAAAIRDELQAYRHN

SEQ ID NO: 554 - protein, 73 aa, Artificial sequence
  artificial construct
MGSWNDFKEELAWIKFDLEALGGSEAELAWFEEDIAMFEQQLQAYKGKGNPEVEALRKEAAAIRDELQAYRHN

SEQ ID NO: 555 - protein, 73 aa, Artificial sequence
  artificial construct
MGSWWDFKDWLAEIKHDLEALGGSEAELALFESEIADFEFGLQWYKGKGNPEVEALRKEAAAIRDELQAYRHN

SEQ ID NO: 556 - protein, 73 aa, Artificial sequence
  artificial construct
MGSWDEFKEDLAHIKTDLEALGGSEAELALFEDEIADFEMYLQHYKGKGNPEVEALRKEAAAIRDELQAYRHN

SEQ ID NO: 557 - protein, 73 aa, Artificial sequence
  artificial construct
MGSWDFFKYDLANINEWLEALGGSEAELADFEYGIADFELWLQDYKGKGNPEVEALRKEAAAIRDELQAYRHN

SEQ ID NO: 558 - protein, 73 aa, Artificial sequence
  artificial construct
MGSWYQFKDDLAHIKHLLEALGGSEAELAVFEYIIADFESFLQIYKGKGNPEVEALRKEAAAIRDELQAYRHN

SEQ ID NO: 559 - protein, 73 aa, Artificial sequence
  artificial construct
MGSWAEFKHDLADIKRELEALGGSEAELAWFELSIAFFEDELQHYKGKGNPEVEALRKEAAAIRDELQAYRHN

SEQ ID NO: 560 - protein, 73 aa, Artificial sequence
  artificial construct
MGSWVVFKQDLADINHQLEALGGSEAELAWFEWEIADFEWELQHYKGKGNPEVEALRKEAAAIRDELQAYRHN

SEQ ID NO: 561 - protein, 73 aa, Artificial sequence
  artificial construct
MGSWFQFKEFLAMITHNLEALGGSEAELAEFEHDIALFESELQQYKGKGNPEVEALRKEAAAIRDELQAYRHN

SEQ ID NO: 562 - protein, 73 aa, Artificial sequence
  artificial construct
MGSWHWFKEDLAMITDVLEALGGSEAELAAFESEIAVFEADLQYYKGKGNPEVEALRKEAAAIRDELQAYRHN

SEQ ID NO: 563 - protein, 73 aa, Artificial sequence
  artificial construct
MGSWSWFQWDLAGIKDHLEALGGSEAELAEFESEIAYFEDELQWYKGKGNPEVEALRKEAAAIRDELQAYRHN

SEQ ID NO: 564 - protein, 73 aa, Artificial sequence
  artificial construct
MGSWTEFKGELAEIKWILEALGGSEAELAFFEDEIAAFEWDLQKYKGKGNPEVEALRKEAAAIRDELQAYRHN

SEQ ID NO: 565 - protein, 73 aa, Artificial sequence
  artificial construct
MGSWFEFKWTLALIKQELEALGGSEAELADFEQEIAEFEWWLQTYKGKGNPEVEALRKEAAAIRDELQAYRHN

SEQ ID NO: 566 - protein, 73 aa, Artificial sequence
  artificial construct
MGSWAEFKQRLAAIKTRLEALGGSEAELAAFMDEIMAFEWELWAYKGKGNPEVEALMNEAFAIDVELYAYRHN

SEQ ID NO: 567 - protein, 73 aa, Artificial sequence
  artificial construct
MGSWAEFKQRLAAIKTRLEALGGSEAELAAFEWEIVAFFSELFAYKGKGNPEVEALRDEAIAIETELVAYRHN

SEQ ID NO: 568 - protein, 73 aa, Artificial sequence
  artificial construct
MGSWWEFDHRLTAIDTRLQALGGSEAELAEFESSIAEFEWWLQDYKGKGNPEVEALFAEAEAIYVELDAYRHN

SEQ ID NO: 569 - protein, 73 aa, Artificial sequence
  artificial construct
MGSWWEFQFRLYAIDQRLLALGGSEAELAEFEQDIADFEWMLQDYKGKGNPEVEALMLEADAIEAELKAYRHN

SEQ ID NO: 570 - protein, 73 aa, Artificial sequence
  artificial construct
MGSWYEFDHRLDAIYQRLWALGGSEAELAEFEYGIAEFEEYLQDYKGKGNPEVEALISEAWAIEWELSAYRHN

SEQ ID NO: 571 - protein, 73 aa, Artificial sequence
  artificial construct
MGSWYEFDMRLDAIWERLTALGGSEAELADFEQYIAEFERQLQDYKGKGNPEVEALFDEAWAIEDELYAYRHN

SEQ ID NO: 572 - protein, 73 aa, Artificial sequence
  artificial construct
MGSWSEFDSRLDAIAYRLFALGGSEAELAQFEWIIADFEEDLQMYKGKGNPEVEALFSEAYAIEIELNAYRHN

SEQ ID NO: 573 - protein, 73 aa, Artificial sequence
  artificial construct
MGSWYEFDDRLDAIAYRLNALGGSEAELAWFEWEIAEFELDLQWYKGKGNPEVEALVWEADAIEWELEAYRHN

SEQ ID NO: 574 - protein, 73 aa, Artificial sequence
  artificial construct
MGSWFEFDERLDAIGSRLTALGGSEAELASFEFYIADFEEWLQQYKGKGNPEVEALEWEAFAIDEELGAYRHN

SEQ ID NO: 575 - protein, 73 aa, Artificial sequence
  artificial construct
MGSWEEFDQRLDAIDVRLYALGGSEAELAEFEFDIAAFEEWLQLYKGKGNPEVEALNMEAFAITDELCAYRHN

SEQ ID NO: 576 - protein, 73 aa, Artificial sequence
  artificial construct
MGSWEEFDVRLDAIFNRLWALGGSEAELAEFEFDIAWFEMDLQEYKGKGNPEVEALFDEAEAITNELVAYRHN

SEQ ID NO: 577 - protein, 73 aa, Artificial sequence
  artificial construct
MGSWEEFDKRLDAITRRLMALGGSEAELAEFESTIAWFEWDLQEYKGKGNPEVEALDWEAYAIDYELGAYRHN

SEQ ID NO: 578 - protein, 73 aa, Artificial sequence
  artificial construct
MGSWYEFDHRLEAIYDRLWALGGSEAELAFFEFDIADFEWDLQSYKGKGNPEVEALFDEAAAIGHELLAYRHN

SEQ ID NO: 579 - protein, 73 aa, Artificial sequence
  artificial construct
MGSWNEFDDRLLAIWGRLDALGGSEAELAFFEEQIAGFEDELQWYKGKGNPEVEALDQEAEAIEKELWAYRHN

SEQ ID NO: 580 - protein, 73 aa, Artificial sequence
  artificial construct
MGSWVEFDDRLDAIWERLDALGGSEAELAWFEEQIAVFEHQLQDYKGKGNPEVEALNQEAEAIDLELKAYRHN

SEQ ID NO: 581 - protein, 73 aa, Artificial sequence
  artificial construct
MGSWTEFDDRLFAIYWRLDALGGSEAELAWFEEVIAEFENDLQVYKGKGNPEVEALDDEAHAISIELEAYRHN

SEQ ID NO: 582 - protein, 73 aa, Artificial sequence
  artificial construct
MGSWSEFDQRLEAIWNRLDALGGSEAELADFEREIAYFENQLQWYKGKGNPEVEALNNEAFAIVDELGAYRHN

SEQ ID NO: 583 - protein, 73 aa, Artificial sequence
  artificial construct
MGSWYEFDERLWAIWERLDALGGSEAELAHFEWVIADFENDLQWYKGKGNPEVEALEFEAEAIVTELHAYRHN

SEQ ID NO: 584 - protein, 73 aa, Artificial sequence
  artificial construct
MGSWMEFDYRLEAIWMRLIALGGSEAELADFESSIADFEHHLQSYKGKGNPEVEALEWEAFAIGVELDAYRHN

SEQ ID NO: 585 - protein, 73 aa, Artificial sequence
  artificial construct
MGSWYEFESRLEAIWWRLEALGGSEAELAQFEQYIADFEQHLQWYKGKGNPEVEALDWEADAIWLELQAYRHN

SEQ ID NO: 586 - protein, 73 aa, Artificial sequence
  artificial construct
MGSWEEFYMRLVAIHMRLRALGGSEAELAVFENYIAEFEEYLQYYKGKGNPEVEALTIEADAIGTELGAYRHN

SEQ ID NO: 587 - protein, 73 aa, Artificial sequence
  artificial construct
MGSWDEFYYRLVAITHRLHALGGSEAELAWFEDDIAGFEWDLQTYKGKGNPEVEALYKEAGAIGMELTAYRHN

SEQ ID NO: 588 - protein, 73 aa, Artificial sequence
  artificial construct
MGSWEEFDTRLLAIFGRLGALGGSEAELALFEMLIAKFEDDLQNYKGKGNPEVEALSEEAFAIDHELGAYRHN

SEQ ID NO: 589 - protein, 73 aa, Artificial sequence
  artificial construct
MGSWREFDQRLWAIDWRLEALGGSEAELAMFEWMIATFEDDLQWYKGKGNPEVEALYREAFAIDWELDAYRHN

SEQ ID NO: 590 - protein, 73 aa, Artificial sequence
  artificial construct
MGSWEEFHERLDAIDERLEALGGSEAELAFFEDDIASFEDWLQWYKGKGNPEVEALSREADAINFELEAYRHN

SEQ ID NO: 591 - protein, 73 aa, Artificial sequence
  artificial construct
MGSWNEFYERLEAIDRRLFALGGSEAELALFEWMIADFEDDLQMYKGKGNPEVEALINEAGAIGFELEAYRHN

SEQ ID NO: 592 - protein, 73 aa, Artificial sequence
  artificial construct
MGSWTEFTQRLEAIVDRLFALGGSEAELAEFENSIADFEWDLQWYKGKGNPEVEALNREAVAIDNELWAYRHN

SEQ ID NO: 593 - protein, 73 aa, Artificial sequence
  artificial construct
MGSWVEFIMRLDAIYERLDALGGSEAELAEFEWHIADFEDHLQWYKGKGNPEVEALFEEADAIWEELWAYRHN

SEQ ID NO: 594 - protein, 73 aa, Artificial sequence
  artificial construct
MGSWNEFLLRLDAIEHRLFALGGSEAELAEFEWEIADFEDDLQWYKGKGNPEVEALVEEAEAIDVELVAYRHN

SEQ ID NO: 595 - protein, 73 aa, Artificial sequence
  artificial construct
MGSWYEFNMRLGAIDDRLQALGGSEAELAWFEDMIAIFEDDLQIYKGKGNPEVEALEQEAAAIHQELWAYRHN

SEQ ID NO: 596 - protein, 73 aa, Artificial sequence
  artificial construct
MGSWEEFHWRLGAIDARLEALGGSEAELAWFEDGIADFEAILQDYKGKGNPEVEALDSEAVAIHHELWAYRHN

SEQ ID NO: 597 - protein, 73 aa, Artificial sequence
  artificial construct
MGSWYEFYERLWAIDDRLWALGGSEAELAEFEDSIATFEPSLQMYKGKGNPEVEALVAEAWAIFDELAAYRHN

SEQ ID NO: 598 - protein, 73 aa, Artificial sequence
  artificial construct
MGSWFEFDQRLDAITFRLWALGGSEAELAEFEDVIALFEYHLQDYKGKGNPEVEALEVEAWAIFHELGAYRHN

SEQ ID NO: 599 - protein, 73 aa, Artificial sequence
  artificial construct
MGSWSEFWFRLDAIEDRLWALGGSEAELAEFEDNIALFEYSLQHYKGKGNPEVEALVKEANAIDDELGAYRHN

SEQ ID NO: 600 - protein, 73 aa, Artificial sequence
  artificial construct
MGSWYEFWDRLTAIEHRLWALGGSEAELAYFEDSIAHFEGSLQVYKGKGNPEVEALYKEAEAIEWELEAYRHN

SEQ ID NO: 601 - protein, 73 aa, Artificial sequence
  artificial construct
MGSWYEFDDRLWAIFDRLFALGGSEAELAFFEDSIAEFEEELQHYKGKGNPEVEALYLEAWAIENELGAYRHN

SEQ ID NO: 602 - protein, 73 aa, Artificial sequence
  artificial construct
MGSWNEFVERLSAIDHRLWALGGSEAELADFEQQIAEFEIHLQEYKGKGNPEVEALDFEADAIFDELLAYRHN

SEQ ID NO: 603 - protein, 73 aa, Artificial sequence
  artificial construct
MGSWSEFVDRLDAIFDRLWALGGSEAELAWFEDTIAHFEWNLQEYKGKGNPEVEALNGEADAITDELHAYRHN

SEQ ID NO: 604 - protein, 73 aa, Artificial sequence
  artificial construct
MGSWAEFDSRLDAIAQRLFALGGSEAELAHFEDFIAQFEYSLQEYKGKGNPEVEALSNEADAIFNELKAYRHN

SEQ ID NO: 605 - protein, 73 aa, Artificial sequence
  artificial construct
MGSWAEFDSRLIAIFDRLWALGGSEAELAWFEDDIAQFEQHLQAYKGKGNPEVEALRQEADAITFELKAYRHN

SEQ ID NO: 606 - protein, 73 aa, Artificial sequence
  artificial construct
MGSWTEFEERLEAIWDRLYALGGSEAELAAFEWDIAYFEDGLQEYKGKGNPEVEALFMEAEAIIRELKAYRHN

SEQ ID NO: 607 - protein, 73 aa, Artificial sequence
  artificial construct
MGSWYEFEDRLAAIWDRLNALGGSEAELAIFEWDIAWFEEGLQEYKGKGNPEVEALKHEASAIQTELFAYRHN

SEQ ID NO: 608 - protein, 73 aa, Artificial sequence
  artificial construct
MGSWLEFESRLWAIWDRLDALGGSEAELAHFEQDIADFEMSLQEYKGKGNPEVEALIREAEAIETELYAYRHN

SEQ ID NO: 609 - protein, 73 aa, Artificial sequence
  artificial construct
MGSWMEFEDRLIAIWARLDALGGSEAELAWFEADIADFEESLQEYKGKGNPEVEALIFEAIAINKELMAYRHN

SEQ ID NO: 610 - protein, 73 aa, Artificial sequence
  artificial construct
MGSWFEFTIRLEAIQDRLDALGGSEAELAWFEWDIAEFEEGLQFYKGKGNPEVEALHTEADAIMNELVAYRHN

SEQ ID NO: 611 - protein, 73 aa, Artificial sequence
  artificial construct
MGSWYEFVSRLDAIEYRLWALGGSEAELAWFEWDIADFEQGLQFYKGKGNPEVEALAQEANAIGSELTAYRHN

SEQ ID NO: 612 - protein, 73 aa, Artificial sequence
  artificial construct
MGSWEEFDYRLYAIQDRLYALGGSEAELAFFEWEIADFEHMLQMYKGKGNPEVEALFQEADAIDAELHAYRHN

SEQ ID NO: 613 - protein, 73 aa, Artificial sequence
  artificial construct
MGSWIEFFHRLDAIQDRLDALGGSEAELAYFEWAIADFEHMLQLYKGKGNPEVEALQFEAFAIEGELYAYRHN

SEQ ID NO: 614 - protein, 73 aa, Artificial sequence
  artificial construct
MGSWYEFSSRLNAIDDRLWALGGSEAELAYFETDIADFESLLQWYKGKGNPEVEALLNEADAIDYELYAYRHN

SEQ ID NO: 615 - protein, 73 aa, Artificial sequence
  artificial construct
MGSWFEFEYRLDAIIDRLFALGGSEAELAEFESMIANFEYSLQEYKGKGNPEVEALYFEADAIVDELTAYRHN

SEQ ID NO: 616 - protein, 73 aa, Artificial sequence
  artificial construct
MGSWLEFEYRLDAIYDRLFALGGSEAELAAFEQDIADFEKYLQYYKGKGNPEVEALWEEADAIMWELFAYRHN

SEQ ID NO: 617 - protein, 73 aa, Artificial sequence
  artificial construct
MGSWHEFEERLMAIEDRLWALGGSEAELAEFEQWIALFEYDLQEYKGKGNPEVEALGMEAFAINNELSAYRHN

SEQ ID NO: 618 - protein, 73 aa, Artificial sequence
  artificial construct
MGSWYEFEERLDAIEDRLIALGGSEAELAIFEDIIAFFEQDLQYYKGKGNPEVEALEMEAEAISIELDAYRHN

SEQ ID NO: 619 - protein, 73 aa, Artificial sequence
  artificial construct
MGSWHEFEKRLYAIEDRLIALGGSEAELAWFEDSIAWFEWDLQMYKGKGNPEVEALNEEADAIYQELDAYRHN

SEQ ID NO: 620 - protein, 73 aa, Artificial sequence
  artificial construct
MGSWIEFEDRLDAITDRLWALGGSEAELAEFEHQIAFFEEDLQWYKGKGNPEVEALHMEAEAIMEELGAYRHN

SEQ ID NO: 621 - protein, 73 aa, Artificial sequence
  artificial construct
MGSWMEFEDRLMAIVDRLWALGGSEAELADFEWNIAMFEEELQWYKGKGNPEVEALGDEAEAIEWELYAYRHN

SEQ ID NO: 622 - protein, 73 aa, Artificial sequence
  artificial construct
MGSWEEFEDRLFAIDSRLWALGGSEAELAEFENIIASFEEVLQEYKGKGNPEVEALSVEAFAIDRELGAYRHN

SEQ ID NO: 623 - protein, 73 aa, Artificial sequence
  artificial construct
MGSWEEFLFRLEAIQDRLWALGGSEAELAWFEYEIASFEDVLQSYKGKGNPEVEALSTEAKAIDYELFAYRHN

SEQ ID NO: 624 - protein, 73 aa, Artificial sequence
  artificial construct
MGSWVEFDNRLFAIDERLWALGGSEAELAWFEEEIASFEDNLQKYKGKGNPEVEALQLEAFAIMEELDAYRHN

SEQ ID NO: 625 - protein, 73 aa, Artificial sequence
  artificial construct
MGSWFEFDDRLEAIFDRLWALGGSEAELAMFEFAIAEFEDALQEYKGKGNPEVEALYEEAVAIDEELYAYRHN

SEQ ID NO: 626 - protein, 73 aa, Artificial sequence
  artificial construct
MGSWFEFDARLMAINDRLWALGGSEAELAAFEYHIALFEDQLQMYKGKGNPEVEALTLEAVAINEELWAYRHN

SEQ ID NO: 627 - protein, 73 aa, Artificial sequence
  artificial construct
MGSWVEFDSRLAAIDYRLEALGGSEAELAWFEYTIANFEHTLQMYKGKGNPEVEALVYEAHAIATELQAYRHN

SEQ ID NO: 628 - protein, 73 aa, Artificial sequence
  artificial construct
MGSWTEFDERLDAIDWRLEALGGSEAELAWFEGDIALFEQYLQVYKGKGNPEVEALMEEADAIKAELDAYRHN

SEQ ID NO: 629 - protein, 73 aa, Artificial sequence
  artificial construct
MGSWIEFDERLDAIDFRLWALGGSEAELAWFEGWIAEFESDLQLYKGKGNPEVEALNEEANAIFHELSAYRHN

SEQ ID NO: 630 - protein, 73 aa, Artificial sequence
  artificial construct
MGSWWEFDSRLDAIDFRLWALGGSEAELAWFEVEIADFEDWLQLYKGKGNPEVEALWHEADAIVTELYAYRHN

SEQ ID NO: 631 - protein, 73 aa, Artificial sequence
  artificial construct
MGSWYEFDERLDAIFDRLWALGGSEAELAYFEQVIATFEKTLQRYKGKGNPEVEALDTEAKAISWELDAYRHN

SEQ ID NO: 632 - protein, 73 aa, Artificial sequence
  artificial construct
MGSWYEFQERLDAIDSRLWALGGSEAELAWFEYTIAEFEKELQMYKGKGNPEVEALGTEAVAISEELMAYRHN

SEQ ID NO: 633 - protein, 73 aa, Artificial sequence
  artificial construct
MGSWEEFEDRLWAIDGRLYALGGSEAELAWFEQWIATFEEDLQDYKGKGNPEVEALEYEASAIFEELEAYRHN

SEQ ID NO: 634 - protein, 73 aa, Artificial sequence
  artificial construct
MGSWFEFGDRLEAIDERLYALGGSEAELAQFEWWIAEFEHHLQDYKGKGNPEVEALEYEADAIWGELHAYRHN

SEQ ID NO: 635 - protein, 73 aa, Artificial sequence
  artificial construct
MGSWFEFNDRLDAISERLSALGGSEAELAYFEWQIAVFEKTLQNYKGKGNPEVEALTLEANAIFEELEAYRHN

SEQ ID NO: 636 - protein, 73 aa, Artificial sequence
  artificial construct
MGSWVEFMDRLEAIEERLSALGGSEAELAFFEWEIAEFEEHLQVYKGKGNPEVEALEWEALAITEELAAYRHN

SEQ ID NO: 637 - protein, 73 aa, Artificial sequence
  artificial construct
MGSWIEFMDRLWAIDQRLWALGGSEAELAWFEEEIAWFEEELQVYKGKGNPEVEALEWEATAISEELWAYRHN

SEQ ID NO: 638 - protein, 73 aa, Artificial sequence
  artificial construct
MGSWEEFNWRLRAIDERLFALGGSEAELAWFEYDIAEFEEQLQVYKGKGNPEVEALRVEAAAIAEELYAYRHN

SEQ ID NO: 639 - protein, 73 aa, Artificial sequence
  artificial construct
MGSWWEFEIRLDAIDERLWALGGSEAELAWFEQSIAFFENDLQVYKGKGNPEVEALRWEANAIIEELFAYRHN

SEQ ID NO: 640 - protein, 73 aa, Artificial sequence
  artificial construct
MGSWYEFEWRLDAIDRRLWALGGSEAELADFEEEIADFEWMLQNYKGKGNPEVEALVDEASAIQTELWAYRHN

SEQ ID NO: 641 - protein, 73 aa, Artificial sequence
  artificial construct
MGSWYEFVYRLRAIDERLDALGGSEAELAMFEFEIAFFEDQLQRYKGKGNPEVEALVDEAQAIDFELFAYRHN

SEQ ID NO: 642 - protein, 73 aa, Artificial sequence
  artificial construct
MGSWWEFEDRLYAIDDRLWALGGSEAELAQFEREIAQFEIWLQEYKGKGNPEVEALDDEATAINSELFAYRHN

SEQ ID NO: 643 - protein, 73 aa, Artificial sequence
  artificial construct
MGSWDEFEFRLEAIDSRLWALGGSEAELAVFEYEIAQFEFMLQEYKGKGNPEVEALGMEAWAIENELFAYRHN

SEQ ID NO: 644 - protein, 73 aa, Artificial sequence
  artificial construct
MGSWEEFEWRLDAIDERLWALGGSEAELATFEYEIAIFENELQQYKGKGNPEVEALDSEAYAIERELGAYRHN

SEQ ID NO: 645 - protein, 73 aa, Artificial sequence
  artificial construct
MGSWYEFFDRLDAIDERLWALGGSEAELAWFEAEIAEFEMELQGYKGKGNPEVEALDVEAHAIEMELFAYRHN

SEQ ID NO: 646 - protein, 73 aa, Artificial sequence
  artificial construct
MGSWYEFMGRLEAIDERLQALGGSEAELAWFEHEIAEFEWSLQWYKGKGNPEVEALRFEAGAIPWELWAYRHN

SEQ ID NO: 647 - protein, 73 aa, Artificial sequence
  artificial construct
MGSWVEFSNRLDAIWERLQALGGSEAELAYFEWEIAEFEWELQSYKGKGNPEVEALNAEADAIEWELEAYRHN

SEQ ID NO: 648 - protein, 73 aa, Artificial sequence
  artificial construct
MGSWEEFHMRLIAIDERLWALGGSEAELAGFEESIAYFESQLQDYKGKGNPEVEALDYEAHAIWRELYAYRHN

SEQ ID NO: 649 - protein, 73 aa, Artificial sequence
  artificial construct
MGSWWEFKYRLDAICFRLAALGGSEAELASFEDEIAYFEEDLQGYKGKGNPEVEALDYEALAIWDELAAYRHN

SEQ ID NO: 650 - protein, 73 aa, Artificial sequence
  artificial construct
MGSWDEFAMRLEAIQARLFALGGSEAELAIFEDEIAFFETMLQDYKGKGNPEVEALEYEAAAIEAELGAYRHN

SEQ ID NO: 651 - protein, 73 aa, Artificial sequence
  artificial construct
MGSWWEFNARLDAIEDRLMALGGSEAELAYFEDIIASFENILQQYKGKGNPEVEALWYEAYAIEKELNAYRHN

SEQ ID NO: 652 - protein, 73 aa, Artificial sequence
  artificial construct
MGSWIEFWNRLEAIEERLYALGGSEAELAYFEDEIAEFEIYLQQYKGKGNPEVEALKHEAEAINKELMAYRHN

SEQ ID NO: 653 - protein, 73 aa, Artificial sequence
  artificial construct
MGSWNEFVIRLFAIDDRLYALGGSEAELAWFEDEIATFEYELQRYKGKGNPEVEALEYEAEAIVSELFAYRHN

SEQ ID NO: 654 - protein, 73 aa, Artificial sequence
  artificial construct
MGSWYEFLARLYAIDERLWALGGSEAELATFEHWIADFEEQLQSYKGKGNPEVEALTDEAVAIGEELSAYRHN

SEQ ID NO: 655 - protein, 73 aa, Artificial sequence
  artificial construct
MGSWLEFETRLHAIDERLWALGGSEAELAEFEEHIAWFEEDLQFYKGKGNPEVEALDFEADAIGWELWAYRHN

SEQ ID NO: 656 - protein, 73 aa, Artificial sequence
  artificial construct
MGSWFEFETRLEAIDLRLWALGGSEAELATFEDVIAFFEDWLQFYKGKGNPEVEALKMEAWAIGEELHAYRHN

SEQ ID NO: 657 - protein, 73 aa, Artificial sequence
  artificial construct
MGSWHEFWQRLEAIEGRLWALGGSEAELADFESLIADFEEQLQEYKGKGNPEVEALMAEAEAIDNELRAYRHN

SEQ ID NO: 658 - protein, 73 aa, Artificial sequence
  artificial construct
MGSWYEFEQRLEAIEWRLGALGGSEAELATFEEDIADFEEWLQEYKGKGNPEVEALQYEAYAIAEELHAYRHN

SEQ ID NO: 659 - protein, 73 aa, Artificial sequence
  artificial construct
MGSWYEFENRLFAIEERLWALGGSEAELAWFEYEIANFEWGLQSYKGKGNPEVEALDNEAEAIDIELAAYRHN

SEQ ID NO: 660 - protein, 73 aa, Artificial sequence
  artificial construct
MGSWYEFEQRLGAIEERLWALGGSEAELAAFEDIIAYFEYQLQSYKGKGNPEVEALDEEAWAIDDELWAYRHN

SEQ ID NO: 661 - protein, 73 aa, Artificial sequence
  artificial construct
MGSWWEFEQRLDAIETRLWALGGSEAELAYFEHIIADFEDELQIYKGKGNPEVEALGWEAFAIDGELTAYRHN

SEQ ID NO: 662 - protein, 73 aa, Artificial sequence
  artificial construct
MGSWFEFPYRLEAIEERLYALGGSEAELAQFEQFIAWFEMDLQDYKGKGNPEVEALWFEANAIVEELDAYRHN

SEQ ID NO: 663 - protein, 73 aa, Artificial sequence
  artificial construct
MGSWVEFYDRLEAIEIRLWALGGSEAELADFESFIAHFEDDLQAYKGKGNPEVEALMDEANAIVFELDAYRHN

SEQ ID NO: 664 - protein, 73 aa, Artificial sequence
  artificial construct
MGSWVEFWDRLDAIEERLWALGGSEAELAEFEFMIAMFEQHLQEYKGKGNPEVEALIPEAGAIDKELTAYRHN

SEQ ID NO: 665 - protein, 73 aa, Artificial sequence
  artificial construct
MGSWDEFDARLWAIEERLWALGGSEAELAEFEFMIAAFEDVLQEYKGKGNPEVEALMGEANAIVMELDAYRHN

SEQ ID NO: 666 - protein, 73 aa, Artificial sequence
  artificial construct
MGSWYEFWRRLDAIEERLWALGGSEAELAMFETDIAGFEWMLQLYKGKGNPEVEALEHEAWAINSELDAYRHN

SEQ ID NO: 667 - protein, 73 aa, Artificial sequence
  artificial construct
MGSWHEFIWRLDAIEERLWALGGSEAELAWFETEIATFEAQLQDYKGKGNPEVEALEWEAIAIAWELDAYRHN

SEQ ID NO: 668 - protein, 73 aa, Artificial sequence
  artificial construct
MGSWYEFYWRLEAIEERLWALGGSEAELAEFEKAIATFEDQLQTYKGKGNPEVEALETEALAIHAELEAYRHN

SEQ ID NO: 669 - protein, 73 aa, Artificial sequence
  artificial construct
MGSWFEFQWRLEAIEDRLWALGGSEAELAEFETIIAGFEEQLQVYKGKGNPEVEALEEEAMAIQTELHAYRHN

SEQ ID NO: 670 - protein, 73 aa, Artificial sequence
  artificial construct
MGSWWEFEDRLWAIEQRLDALGGSEAELAVFENSIAKFEDMLQVYKGKGNPEVEALHEEADAIIWELYAYRHN

SEQ ID NO: 671 - protein, 73 aa, Artificial sequence
  artificial construct
MGSWWEFEDRLWAIDRRLMALGGSEAELAVFEQMIAHFEQILQVYKGKGNPEVEALHFEAHAIGMELAAYRHN

SEQ ID NO: 672 - protein, 73 aa, Artificial sequence
  artificial construct
MGSWWEFLDRLEAIEYRLQALGGSEAELAVFEWEIAMFEDHLQGYKGKGNPEVEALHSEAHAIISELSAYRHN

SEQ ID NO: 673 - protein, 73 aa, Artificial sequence
  artificial construct
MGSWAEFEDRLAAIERRLEALGGSEAELADFESSIAWFEPDLQYYKGKGNPEVEALMYEAEAIFSELYAYRHN

SEQ ID NO: 674 - protein, 73 aa, Artificial sequence
  artificial construct
MGSWWEFYDRLTAIEARLWALGGSEAELADFEEGIADFEYDLQDYKGKGNPEVEALFWEAWAIQSELTAYRHN

SEQ ID NO: 675 - protein, 73 aa, Artificial sequence
  artificial construct
MGSWYEFEDRLAAIEARLWALGGSEAELADFEEEIAYFEHGLQWYKGKGNPEVEALESEAMAIIDELHAYRHN

SEQ ID NO: 676 - protein, 73 aa, Artificial sequence
  artificial construct
MGSWWEFSWRLEAIETRLDALGGSEAELAFFEMDIAWFEQDLQLYKGKGNPEVEALEEEAYAIYEELEAYRHN

SEQ ID NO: 677 - protein, 73 aa, Artificial sequence
  artificial construct
MGSWEEFFFRLEAIDDRLYALGGSEAELALFEEVIAYFEQDLQWYKGKGNPEVEALYVEAYAIQEELYAYRHN

SEQ ID NO: 678 - protein, 73 aa, Artificial sequence
  artificial construct
MGSWFEFEERLNAISWRLHALGGSEAELAYFEEDIAWFEDDLQFYKGKGNPEVEALENEAYAIWEELDAYRHN

SEQ ID NO: 679 - protein, 73 aa, Artificial sequence
  artificial construct
MGSWFEFEERLEAIIYRLWALGGSEAELAMFEESIAWFESDLQQYKGKGNPEVEALEYEAMAISKELKAYRHN

SEQ ID NO: 680 - protein, 73 aa, Artificial sequence
  artificial construct
MGSWAEFDDRLEAIEYRLHALGGSEAELAWFEEGIAGFEHALQSYKGKGNPEVEALETEAGAINEELWAYRHN

SEQ ID NO: 681 - protein, 73 aa, Artificial sequence
  artificial construct
MGSWDEFEERLQAIEYRLWALGGSEAELAWFEEVIAQFEYDLQKYKGKGNPEVEALSTEAQAIQDELWAYRHN

SEQ ID NO: 682 - protein, 73 aa, Artificial sequence
  artificial construct
MGSWWEFTDRLDAIFDRLWALGGSEAELAAFEESIAIFEQDLQYYKGKGNPEVEALEYEANAIQYELEAYRHN

SEQ ID NO: 683 - protein, 73 aa, Artificial sequence
  artificial construct
MGSWWEFTDRLEAIEDRLWALGGSEAELAHFEDSIAQFEQELQWYKGKGNPEVEALADEADAIESELHAYRHN

SEQ ID NO: 684 - protein, 73 aa, Artificial sequence
  artificial construct
MGSWVEFFWRLDAIEDRLWALGGSEAELANFEFEIADFEAWLQKYKGKGNPEVEALHSEADAIQLELRAYRHN

SEQ ID NO: 685 - protein, 73 aa, Artificial sequence
  artificial construct
MGSWVEFYNRLDAIENRLWALGGSEAELAFFEELIAQFEFALQDYKGKGNPEVEALEDEADAIWEELMAYRHN

SEQ ID NO: 686 - protein, 73 aa, Artificial sequence
  artificial construct
MGSWEEFYYRLHAIDNRLWALGGSEAELAYFEWHIADFELELQDYKGKGNPEVEALSEEATAIFEELWAYRHN

SEQ ID NO: 687 - protein, 73 aa, Artificial sequence
  artificial construct
MGSWREFHDRLFAIDGRLWALGGSEAELANFEWDIADFEFELQDYKGKGNPEVEALSWEADAIMQELGAYRHN

SEQ ID NO: 688 - protein, 73 aa, Artificial sequence
  artificial construct
MGSWEEFDERLWAISDRLWALGGSEAELAYFEGEIAYFEQNLQTYKGKGNPEVEALQTEALAIDTELWAYRHN

SEQ ID NO: 689 - protein, 73 aa, Artificial sequence
  artificial construct
MGSWEEFEQRLWAIDDRLWALGGSEAELAFFEYEIAEFEMDLQWYKGKGNPEVEALFYEAHAINEELWAYRHN

SEQ ID NO: 690 - protein, 73 aa, Artificial sequence
  artificial construct
MGSWDEFHQRLAAIGDRLWALGGSEAELAYFEWEIATFEWDLQVYKGKGNPEVEALYFEATAIDEELMAYRHN

SEQ ID NO: 691 - protein, 73 aa, Artificial sequence
  artificial construct
MGSWVEFEYRLDAISDRLWALGGSEAELAFFENEIASFESDLQFYKGKGNPEVEALMFEAEAIDDELHAYRHN

SEQ ID NO: 692 - protein, 73 aa, Artificial sequence
  artificial construct
MGSWDEFDTRLDAIFSRLYALGGSEAELAMFEGEIAEFEGSLQHYKGKGNPEVEALDFEAHAIDEELWAYRHN

SEQ ID NO: 693 - protein, 73 aa, Artificial sequence
  artificial construct
MGSWHEFDDRLDAIMSRLDALGGSEAELATFEAEIATFEFVLQLYKGKGNPEVEALLAEAYAIDWELEAYRHN

SEQ ID NO: 694 - protein, 73 aa, Artificial sequence
  artificial construct
MGSWYEFFDRLDAIYDRLYALGGSEAELASFEAQIAEFEVELQSYKGKGNPEVEALEWEAWAIDEELYAYRHN

SEQ ID NO: 695 - protein, 73 aa, Artificial sequence
  artificial construct
MGSWFEFLYRLDAIEDRLWALGGSEAELAEFEQEIAKFESELQSYKGKGNPEVEALEWEAHAIDMELEAYRHN

SEQ ID NO: 696 - protein, 73 aa, Artificial sequence
  artificial construct
MGSWLEFEDRLVAIDHRLFALGGSEAELAEFEEEIALFESYLQDYKGKGNPEVEALNWEADAIHAELYAYRHN

SEQ ID NO: 697 - protein, 73 aa, Artificial sequence
  artificial construct
MGSWYEFESRLDAIVDRLWALGGSEAELAEFEYEIAKFEWELQDYKGKGNPEVEALNWEAGAIEFELYAYRHN

SEQ ID NO: 698 - protein, 73 aa, Artificial sequence
  artificial construct
MGSWYEFEDRLDAILYRLLALGGSEAELAWFERDIAFFESELQWYKGKGNPEVEALEWEAMAIDDELFAYRHN

SEQ ID NO: 699 - protein, 73 aa, Artificial sequence
  artificial construct
MGSWGEFMDRLEAIDYRLWALGGSEAELAWFESDIAEFEQELQMYKGKGNPEVEALWDEAMAIRDELFAYRHN

SEQ ID NO: 700 - protein, 73 aa, Artificial sequence
  artificial construct
MGSWEEFDDRLDAIEHRLWALGGSEAELADFEGSIAAFESWLQVYKGKGNPEVEALEAEAEAIADELWAYRHN

SEQ ID NO: 701 - protein, 73 aa, Artificial sequence
  artificial construct
MGSWYEFADRLDAIMDRLVALGGSEAELAYFEWEIAAFEEFLQMYKGKGNPEVEALDEEAEAIKDELMAYRHN

SEQ ID NO: 702 - protein, 73 aa, Artificial sequence
  artificial construct
MGSWNEFWERLDAIEWRLFALGGSEAELAFFELDIAWFEEELQWYKGKGNPEVEALIFEAHAITLELDAYRHN

SEQ ID NO: 703 - protein, 73 aa, Artificial sequence
  artificial construct
MGSWYEFDARLDAIEERLYALGGSEAELAAFEFEIAGFEEALQWYKGKGNPEVEALLKEAEAITDELYAYRHN

SEQ ID NO: 704 - protein, 73 aa, Artificial sequence
  artificial construct
MGSWDEFSERLDAIWGRLEALGGSEAELATFEFHIAEFEHELQYYKGKGNPEVEALQGEAAAIINELYAYRHN

SEQ ID NO: 705 - protein, 73 aa, Artificial sequence
  artificial construct
MGSWDEFWDRLDAIEDRLFALGGSEAELADFERVIAWFENDLQEYKGKGNPEVEALDNEADAIRIELHAYRHN

SEQ ID NO: 706 - protein, 73 aa, Artificial sequence
  artificial construct
MGSWDEFDDRLEAIVDRLFALGGSEAELAMFEFEIAQFEHQLQYYKGKGNPEVEALRDEADAIWIELDAYRHN

SEQ ID NO: 707 - protein, 73 aa, Artificial sequence
  artificial construct
MGSWEEFTIRLGAIYWRLFALGGSEAELANFEWFIAEFEYELQPYKGKGNPEVEALVIEANAIDGELQAYRHN

SEQ ID NO: 708 - protein, 73 aa, Artificial sequence
  artificial construct
MGSWFEFEWRLDAIENRLNALGGSEAELAWFEYHIAAFEDSLQHYKGKGNPEVEALEWEAHAIQSELQAYRHN

SEQ ID NO: 709 - protein, 73 aa, Artificial sequence
  artificial construct
MGSWYEFDDRLEAIWDRLGALGGSEAELAAFEKEIAAFESELQAYKGKGNPEVEWLRETAADIRAELQAYRHN

SEQ ID NO: 710 - protein, 73 aa, Artificial sequence
  artificial construct
MGSWGEFWARLEAIWIRLDALGGSEAELAAFEKEIAAFESELQAYKGKGNPEVEWLREEAADIRRSLQAYRHN

SEQ ID NO: 711 - protein, 73 aa, Artificial sequence
  artificial construct
MGSWIEFEVRLDAIWDRLFALGGSEAELAAFEKEIAAFESELQAYKGKGNPEVEYLRDEAADIRQSLQAYRHN

SEQ ID NO: 712 - protein, 73 aa, Artificial sequence
  artificial construct
MGSWTEFDRRLDAIWDRLFALGGSEAELAAFEKEIAAFESELQAYKGKGNPEVEWLREEAADIRDYLQAYRHN

SEQ ID NO: 713 - protein, 73 aa, Artificial sequence
  artificial construct
MGSWTEFDMRLDAIWDRLFALGGSEAELAAFEKEIAAFESELQAYKGKGNPEVEELREEAATIRGVLQAYRHN

SEQ ID NO: 714 - protein, 73 aa, Artificial sequence
  artificial construct
MGSWEEFHDRLMAIETRLWALGGSEAELAAFEKEIAAFESELQAYKGKGNPEVEWLRYEAADIRDYLQAYRHN

SEQ ID NO: 715 - protein, 73 aa, Artificial sequence
  artificial construct
MGSWVEFRDRLDAIETRLWALGGSEAELAAFEKEIAAFESELQAYKGKGNPEVEWLRYEAAEIRMVLQAYRHN

SEQ ID NO: 716 - protein, 73 aa, Artificial sequence
  artificial construct
MGSWMEFIDRLDAIEHRLWALGGSEAELAAFEKEIAAFESELQAYKGKGNPEVEFLREEAAEIRMYLQAYRHN

SEQ ID NO: 717 - protein, 73 aa, Artificial sequence
  artificial construct
MGSWTEFVWRLDAIEWRLEALGGSEAELAAFEKEIAAFESELQAYKGKGNPEVEFLREEAAEIRDWLQAYRHN

SEQ ID NO: 718 - protein, 73 aa, Artificial sequence
  artificial construct
MGSWVEFYDRLYAIEVRLLALGGSEAELAAFEKEIAAFESELQAYKGKGNPEVEFLRQEAAEIRDWLQAYRHN

SEQ ID NO: 719 - protein, 73 aa, Artificial sequence
  artificial construct
MGSWYEFYDRLDAIEWRLWALGGSEAELAAFEKEIAAFESELQAYKGKGNPEVEWLRDEAAQIRDFLQAYRHN

SEQ ID NO: 720 - protein, 73 aa, Artificial sequence
  artificial construct
MGSWVEFYDRLDAIEHRLDALGGSEAELAAFEKEIAAFESELQAYKGKGNPEVEWLRDEAAFIRDMLQAYRHN

SEQ ID NO: 721 - protein, 73 aa, Artificial sequence
  artificial construct
MGSWFEFVDRLTAIQVRLWALGGSEAELAAFEKEIAAFESELQAYKGKGNPEVEYLREEAALIRYSLQAYRHN

SEQ ID NO: 722 - protein, 73 aa, Artificial sequence
  artificial construct
MGSWFEFLDRLDAIEERLWALGGSEAELAAFEKEIAAFESELQAYKGKGNPEVEWLREEAAVIRDSLQAYRHN

SEQ ID NO: 723 - protein, 73 aa, Artificial sequence
  artificial construct
MGSWYEFMVRLDAIEERLFALGGSEAELAAFEKEIAAFESELQAYKGKGNPEVEFLREEAASIRYHLQAYRHN

SEQ ID NO: 724 - protein, 73 aa, Artificial sequence
  artificial construct
MGSWYEFEDRLDAIQWRLWALGGSEAELAAFEKEIAAFESELQAYKGKGNPEVEFLRESAANIRQHLQAYRHN

SEQ ID NO: 725 - protein, 73 aa, Artificial sequence
  artificial construct
MGSWSEFEYRLFAIENRLDALGGSEAELAAFEKEIAAFESELQAYKGKGNPEVEFLREEAAMIRQLLQAYRHN

SEQ ID NO: 726 - protein, 73 aa, Artificial sequence
  artificial construct
MGSWVEFEYRLDAITERLLALGGSEAELAAFEKEIAAFESELQAYKGKGNPEVEILREEAAFIRQWLQAYRHN

SEQ ID NO: 727 - protein, 73 aa, Artificial sequence
  artificial construct
MGSWWEFLDRLDAIEMRLFALGGSEAELAAFEKEIAAFESELQAYKGKGNPEVEYLREEAALIRNMLQAYRHN

SEQ ID NO: 728 - protein, 73 aa, Artificial sequence
  artificial construct
MGSWWEFEDRLDAIEYRLFALGGSEAELAAFEKEIAAFESELQAYKGKGNPEVEFLREEAAFIRIFLQAYRHN

SEQ ID NO: 729 - protein, 73 aa, Artificial sequence
  artificial construct
MGSWWEFESRLDAIFMRLTALGGSEAELAAFEKEIAAFESELQAYKGKGNPEVEDLREDAAFIREFLQAYRHN

SEQ ID NO: 730 - protein, 73 aa, Artificial sequence
  artificial construct
MGSWVEFWHRLDAIKARLNALGGSEAELAAFEKEIAAFESELQAYKGKGNPEVEDLRWYAADFRLILQAYRHN

SEQ ID NO: 731 - protein, 73 aa, Artificial sequence
  artificial construct
MGSWYEFYNRLSAIYARLQALGGSEAELAAFEKEIAAFESELQAYKGKGNPEVEDLRWYAADIRYMLQAYRHN

SEQ ID NO: 732 - protein, 73 aa, Artificial sequence
  artificial construct
MGSWYEFYDRLSAIYARLQALGGSEAELAAFEKEIAAFESELQAYKGKGNPEVEDLRWYAADIRYMLQAYRHN

SEQ ID NO: 733 - protein, 73 aa, Artificial sequence
  artificial construct
MGSWNEFYDRLSAIYFRLQALGGSEAELAAFEKEIAAFESELQAYKGKGNPEVEHLRWYAADIRMILQAYRHN

SEQ ID NO: 734 - protein, 73 aa, Artificial sequence
  artificial construct
MGSWNEFYDRLSAIYFRLQALGGFEAELAAFEKEIAAFESELQAYKGKGNPEVEHLRWYAADIRMILQAYRHN

SEQ ID NO: 735 - protein, 73 aa, Artificial sequence
  artificial construct
MGSWEEFYDRLGAIFARLHALGGSEAELAAFEKEIAAFESELQAYKGKGNPEVEDLRWYAADIRMILQAYRHN

SEQ ID NO: 736 - protein, 73 aa, Artificial sequence
  artificial construct
MGSWVEFYDRLHAIYFRLLALGGSEAELAAFEKEIAAFESELQAYKGKGNPEVEDLRWYAADIRLVLQAYRHN

SEQ ID NO: 737 - protein, 73 aa, Artificial sequence
  artificial construct
MGSWKEFDNRLYAIEDRLRALGGSEAELAAFEKEIAAFESELQAYKGKGNPEVEHLRWYAADIRMILQAYRHN

SEQ ID NO: 738 - protein, 73 aa, Artificial sequence
  artificial construct
MGSWVEFWDRLWAIEDRLWALGGSEAELAAFEKEIAAFESELQAYKGKGNPEVEHLRHYAADIRVWLQAYRHN

SEQ ID NO: 739 - protein, 73 aa, Artificial sequence
  artificial construct
MGSWYEFADRLWAIEDRLWALGGSEAELAAFEKEIAAFESELQAYKGKGNPEVEFLRYYAADIRWVLQAYRHN

SEQ ID NO: 740 - protein, 73 aa, Artificial sequence
  artificial construct
MGSWYEFEERLYAIEDRLYALGGSEAELAAFEKEIAAFESELQAYKGKGNPEVEFLRQEAADIRLMLQAYRHN

SEQ ID NO: 741 - protein, 73 aa, Artificial sequence
  artificial construct
MGSWTEFEWRLYAIEDRLMALGGSEAELAAFEKEIAAFESELQAYKGKGNPEVEFLRDEAADIRQYLQAYRHN

SEQ ID NO: 742 - protein, 73 aa, Artificial sequence
  artificial construct
MGSWIEFESRLWAIEDRLLALGGSEAELAAFEKEIAAFESELQAYKGKGNPEVEFLRLEAADIREDLQAYRHN

SEQ ID NO: 743 - protein, 73 aa, Artificial sequence
  artificial construct
MGSWFEFEDRLDAIWDRLWALGGSEAELAAFEKEIAAFESELQAYKGKGNPEVEFLRMDAAMIRYILQAYRHN

SEQ ID NO: 744 - protein, 73 aa, Artificial sequence
  artificial construct
MGSWEEFEDRLWAIEDRLWALGGSEAELAAFEKEIAAFESELQAYKGKGNPEVEILRYDAAYIREILQAYRHN

SEQ ID NO: 745 - protein, 73 aa, Artificial sequence
  artificial construct
MGSWIEFEDRLYAIEDRLWALGGSEAELAAFEKEIAAFESELQAYKGKGNPEVEFLRYEAAEIRYWLQAYRHN

SEQ ID NO: 746 - protein, 73 aa, Artificial sequence
  artificial construct
MGSWYEFWDRLEAIEDRLWALGGSEAELAAFEKEIAAFESELQAYKGKGNPEVEFLRYSAAEIRYQLQAYRHN

SEQ ID NO: 747 - protein, 73 aa, Artificial sequence
  artificial construct
MGSWVEFESRLAAIEHRLWALGGSEAELAAFEKEIAAFESELQAYKGKGNPEVEELREYAAEIRDWLQAYRHN

SEQ ID NO: 748 - protein, 73 aa, Artificial sequence
  artificial construct
MGSWWEFEHRLFAIEDRLWALGGSEAELAAFEKEIAAFESELQAYKGKGNPEVEFLRDYAAEIRDYLQAYRHN

SEQ ID NO: 749 - protein, 73 aa, Artificial sequence
  artificial construct
MGSWYEFDSRLMAIEDRLWALGGSEAELAAFEKEIAAFESELQAYKGKGNPEVEYLRQEAAEIRMILQAYRHN

SEQ ID NO: 750 - protein, 73 aa, Artificial sequence
  artificial construct
MGSWYEFEWRLMAIEDRLWALGGSEAELAAFEKEIAAFESELQAYKGKGNPEVEYLRHEAAEIRDVLQAYRHN

SEQ ID NO: 751 - protein, 73 aa, Artificial sequence
  artificial construct
MGSWYEFYNRLDAIEDRLWALGGSEAELAAFEKEIAAFESELQAYKGKGNPEVEYLRQEAADIRGQLQAYRHN

SEQ ID NO: 752 - protein, 73 aa, Artificial sequence
  artificial construct
MGSWWEFHDRLEAIEDRLWALGGSEAELAAFEKEIAAFESELQAYKGKGNPEVEYLRIEAADIRRQLQAYRHN

SEQ ID NO: 753 - protein, 73 aa, Artificial sequence
  artificial construct
MGSWYEFWDRLEAIEERLWALGGSEAELAAFEKEIAAFESELQAYKGKGNPEVEYLRLEAADIRRILQAYRHN

SEQ ID NO: 754 - protein, 73 aa, Artificial sequence
  artificial construct
MGSWYEFEERLWAIEERLYALGGSEAELAAFEKEIAAFESELQAYKGKGNPEVEYLRYEAAWIRDFLQAYRHN

SEQ ID NO: 755 - protein, 73 aa, Artificial sequence
  artificial construct
MGSWYEFENRLEAIEERLWALGGSEAELAAFEKEIAAFESELQAYKGKGNPEVEMLREEAAFIRDWLQAYRHN

SEQ ID NO: 756 - protein, 73 aa, Artificial sequence
  artificial construct
MGSWYEFEYRLEAIEDRLWALGGSEAELAAFEKEIAAFESELQAYKGKGNPEVEYLREEAAWIRVWLQAYRHN

SEQ ID NO: 757 - protein, 73 aa, Artificial sequence
  artificial construct
MGSWYEFENRLGAIGDRLWALGGSEAELAAFEKEIAAFESELQAYKGKGNPEVEWLRDEAAYIRAVLQAYRHN

SEQ ID NO: 758 - protein, 73 aa, Artificial sequence
  artificial construct
MGSWYEFEHRLDAIYDRLWALGGSEAELAAFEKEIAAFESELQAYKGKGNPEVEWLREEAAWIRLWLQAYRHN

SEQ ID NO: 759 - protein, 73 aa, Artificial sequence
  artificial construct
MGSWYEFEWRLDAIYDRLGALGGSEAELAAFEKEIAAFESELQAYKGKGNPEVEWLREDAAEIRALLQAYRHN

SEQ ID NO: 760 - protein, 73 aa, Artificial sequence
  artificial construct
MGSWVEFENRLEAIENRLWALGGSEAELAAFEKEIAAFESELQAYKGKGNPEVEWLREDAAQIRMMLQAYRHN

SEQ ID NO: 761 - protein, 73 aa, Artificial sequence
  artificial construct
MGSWYEFEERLEAIEDRLWALGGSEAELAAFEKEIAAFESELQAYKGKGNPEVEWLREQAAFIRTMLQAYRHN

SEQ ID NO: 762 - protein, 73 aa, Artificial sequence
  artificial construct
MGSWFEFEWRLEAIFDRLYALGGSEAELAAFEKEIAAFESELQAYKGKGNPEVEVLRAEAAEIRLRLQAYRHN

SEQ ID NO: 763 - protein, 73 aa, Artificial sequence
  artificial construct
MGSWWEFEDRLMAIYDRLYALGGSEAELAAFEKEIAAFESELQAYKGKGNPEVEYLRAEAALIRETLQAYRHN

SEQ ID NO: 764 - protein, 73 aa, Artificial sequence
  artificial construct
MGSWFEFEDRLYAIEDRLYALGGSEAELAAFEKEIAAFESELQAYKGKGNPEVEYLRWGAATIRDELQAYRHN

SEQ ID NO: 765 - protein, 73 aa, Artificial sequence
  artificial construct
MGSWIEFWDRLEAIEDRLWALGGSEAELAAFEKEIAAFESELQAYKGKGNPEVEELRDEAAWIRDSLQAYRHN

SEQ ID NO: 766 - protein, 73 aa, Artificial sequence
  artificial construct
MGSWFEFWDRLDAIEDRLYALGGSEAELAAFEKEIAAFESELQAYKGKGNPEVEELRDEAAWIRGTLQAYRHN

SEQ ID NO: 767 - protein, 73 aa, Artificial sequence
  artificial construct
MGSWEEFTDRLWAIEDRLYALGGSEAELAAFEKEIAAFESELQAYKGKGNPEVEWLRDEAAFIRKSLQAYRHN

SEQ ID NO: 768 - protein, 73 aa, Artificial sequence
  artificial construct
MGSWVEFVDRLEAIEDRLFALGGSEAELAAFEKEIAAFESELQAYKGKGNPEVEFLRDQAAYIRFMLQAYRHN

SEQ ID NO: 769 - protein, 73 aa, Artificial sequence
  artificial construct
MGSWFEFVDRLEAIEMRLFALGGSEAELAAFEKEIAAFESELQAYKGKGNPEVELLRWRAAMIRYDLQAYRHN

SEQ ID NO: 770 - protein, 73 aa, Artificial sequence
  artificial construct
MGSWWEFEMRLEAIEDRLFALGGSEAELAAFEKEIAAFESELQAYKGKGNPEVESLRWEAAFIRDILQAYRHN

SEQ ID NO: 771 - protein, 73 aa, Artificial sequence
  artificial construct
MGSWFEFEIRLEAIEDRLFALGGSEAELAAFEKEIAAFESELQAYKGKGNPEVEFLRDEAAEIRQVLQAYRHN

SEQ ID NO: 772 - protein, 73 aa, Artificial sequence
  artificial construct
MGSWYEFYQRLEAIEDRLFALGGSEAELAAFEKEIAAFESELQAYKGKGNPEVEWLRDEAAEIRVVLQAYRHN

SEQ ID NO: 773 - protein, 73 aa, Artificial sequence
  artificial construct
MGSWIEFEDRLEAIEDRLFALGGSEAELAAFEKEIAAFESELQAYKGKGNPEVEWLRQEAAEIRLMLQAYRHN

SEQ ID NO: 774-779 - skipped (6 entries)

SEQ ID NO: 780 - protein, 73 aa, Artificial sequence
  artificial construct
MGSWVEFEARLSAIYERLEALGGSEAELAAFEKEIAAFESELQAYKGKGNPEVEKLRRHAAGIRSNLQAYRHN

SEQ ID NO: 781 - protein, 73 aa, Artificial sequence
  artificial construct
MGSWVEFFVRLDAIWERLEALGGSEAELAAFEKEIAAFESELQAYKGKGNPEVETLRFHAAGIRQKLQAYRHN

SEQ ID NO: 782 - protein, 73 aa, Artificial sequence
  artificial construct
MGSWTEFNLRLDAIYERLEALGGSEAELAAFEKEIAAFESELQAYKGKGNPEVEALRWHAAGIRQQLQAYRHN

SEQ ID NO: 783 - protein, 73 aa, Artificial sequence
  artificial construct
MGSWMEFYDRLDAIWVRLEALGGSEAELAAFEKEIAAFESELQAYKGKGNPEVEVLRFHAAGIREQLQAYRHN

SEQ ID NO: 784 - protein, 73 aa, Artificial sequence
  artificial construct
MGSWHEFNGRLWAIYARLDALGGSEAELAAFEKEIAAFESELQAYKGKGNPEVETLRRHAAGIRGILQAYRHN

SEQ ID NO: 785 - protein, 73 aa, Artificial sequence
  artificial construct
MGSWYEFVQRLHAINDRLSALGGSEAELAAFEKEIAAFESELQAYKGKGNPEVEVLRRHAAGIRYTLQAYRHN

SEQ ID NO: 786 - protein, 73 aa, Artificial sequence
  artificial construct
MGSWAEFYQRLNAIWNRLEALGGSEAELAAFEKEIAAFESELQAYKGKGNPEVEVLRRHAAGIRGQLQAYRHN

SEQ ID NO: 787 - protein, 73 aa, Artificial sequence
  artificial construct
MGSWVEFNERLHAIYLRLDALGGSEAELAAFEKEIAAFESELQAYKGKGNPEVETLRRHAAGIRWQLQAYRHN

SEQ ID NO: 788 - protein, 73 aa, Artificial sequence
  artificial construct
MGSWNEFKLELAFIKDWLEALGGSEAELANFEEAIAEFEAGLQGYKGKGNPEVEALRKEAAAIRDELQAYRHN

SEQ ID NO: 789 - protein, 73 aa, Artificial sequence
  artificial construct
MGSWMEFEARLEAIWDRLEALGGSEAELAAFEKEIAAFESELQAYKGKGNPEVESLRFHAAGIRQHLQAYRHN

SEQ ID NO: 790 - protein, 73 aa, Artificial sequence
  artificial construct
MGSWVEFEDRLNAIWWRLEALGGSEAELAAFEKEIAAFESELQAYKGKGNPEVEKLRRHAAGIRTQLQAYRHN

SEQ ID NO: 791 - protein, 73 aa, Artificial sequence
  artificial construct
MGSWHHFKMHLAGIKLQLEALGGSEAELAEFEEWIADFEGALQDYKGKGNPEVEALRKEAAAIRDELQAYRHN

SEQ ID NO: 792 - protein, 73 aa, Artificial sequence
  artificial construct
MGSWAEFFARLDAIWERLEALGGSEAELAAFEKEIAAFESELQAYKGKGNPEVETLRFHAAGIRQKLQAYRHN

SEQ ID NO: 793 - protein, 73 aa, Artificial sequence
  artificial construct
MGSWAEFFARLDAIWDRLEALGGSEAELAAFEKEIAAFESELQAYKGKGNPEVETLRFHAAGIRQKLQAYRHN

SEQ ID NO: 794 - protein, 73 aa, Artificial sequence
  artificial construct
MGSWAEFFARLDAIWERLEALGGSEAELAAFEKEIAAFESELQAYKGKGNPEVETLKFHAAGIRQKLQAYRHN

SEQ ID NO: 795 - protein, 73 aa, Artificial sequence
  artificial construct
MGSWAEFFARLDAIWDRLEALGGSEAELAAFEKEIAAFESELQAYKGKGNPEVETLKFHAAGIRQKLQAYRHN

SEQ ID NO: 796-799 - skipped (4 entries)

SEQ ID NO: 800 - protein, 73 aa, Artificial sequence
  artificial construct
MGSWHEFRWRLFAIWQRLHALGGSEAELAAFEKEIAAFESELQAYKGKGNPEVEWLRLDAALIRVMLQAYRHN

SEQ ID NO: 801 - protein, 73 aa, Artificial sequence
  artificial construct
MGSWAEFRWRLHAIWLKLGELGGSEAELAAFEKEIAAFESELQAYKGKGNPEVEWLREDAEQIKYILQAYRHN

SEQ ID NO: 802 - protein, 73 aa, Artificial sequence
  artificial construct
MGSWAEFRWALHAIWLKLGELGGSEAELAAFEKEIAAFESELQAYKGKGNPEVEWLREDAEQIKYILQAYRHN

SEQ ID NO: 803 - protein, 73 aa, Artificial sequence
  artificial construct
MGSWAEFRWRLHAIWLKLGALGGSEAELAAFEKEIAAFESELQAYKGKGNPEVEWLRQDAAQIKYILQAYRHN

SEQ ID NO: 804 - protein, 73 aa, Artificial sequence
  artificial construct
MGSWAEFRWRLHAIWLQLGALGGSEAELAAFEKEIAAFESELQAYKGKGNPEVEWLRQDAAQIKYILQAYRHN

SEQ ID NO: 805 - protein, 73 aa, Artificial sequence
  artificial construct
MGSWAEFRWRLHAIWLRLGALGGTEAELAAFEKEIAAFESELQAYKGKGNPEVEWLRQDAAQIKYILQAYRHN

SEQ ID NO: 806 - protein, 73 aa, Artificial sequence
  artificial construct
MGSWAEFRWRLHAIWLRLGALGGSEAELAAFEKEIAAFESELQAYKGKGNPEVEWLRQDAAQIKYILQAYRHN

SEQ ID NO: 807 - protein, 73 aa, Artificial sequence
  artificial construct
MGSWAEFRWKLEAIWLRLGALGGSEAELAAFEKEIAAFESELQAYKGKGNPEVEWLRQDAAQIKYILQAYRHN

SEQ ID NO: 808 - protein, 73 aa, Artificial sequence
  artificial construct
MGSWAEFRWKLGAIWLRLGALGGSEAELAAFEKEIAAFESELQAYKGKGNPEVEWLRQDAAQIKYILQAYRHN

SEQ ID NO: 809 - protein, 73 aa, Artificial sequence
  artificial construct
MGSWYEFRWRLHAIWLRLGALGGSEAELAAFEKEIAAFESELQAYKGKGNPEVEWLRQDAAQIRYILQAYRHN

SEQ ID NO: 810 - protein, 73 aa, Artificial sequence
  artificial construct
MGSWHEFLRRLLAIEMRLYALGGSEAELAAFEKEIAAFESELQAYKGKGNPEVEHLRVRAASIRQMLQAYRHN

SEQ ID NO: 811 - protein, 73 aa, Artificial sequence
  artificial construct
MGSWWGFKVNLAWIKWKLEALGGSEAELAYFELWIANFEHSLQEYKGKGNPEVEALRKEAAAIRDELQAYRHN

SEQ ID NO: 812 - protein, 73 aa, Artificial sequence
  artificial construct
MGSWVNFKTHLARIKVHLEALGGSEAELALFEHDIANFEQVLQQYKGKGNPEVEALRKEAAAIRDELQAYRHN

SEQ ID NO: 813 - protein, 73 aa, Artificial sequence
  artificial construct
MGSWLVFKDELAGIKNYLEALGGSEAELATFEQDIAWFEQWLQNYKGKGNPEVEALRKEAAAIRDELQAYRHN

SEQ ID NO: 814 - protein, 73 aa, Artificial sequence
  artificial construct
MGSWKTFKIELAGIKLELEALGGSEAELAGFENAIAQFESSLQYYKGKGNPEVEALRKEAAAIRDELQAYRHN

SEQ ID NO: 815 - protein, 73 aa, Artificial sequence
  artificial construct
MGSWWEFKVRLSAIQYRLYALGGSEAELAAFEKEIAAFESELQAYKGKGNPEVEALREQAALIRTILQAYRHN

SEQ ID NO: 816 - protein, 73 aa, Artificial sequence
  artificial construct
MGSWWEFHIRLHAINYRLAALGGSEAELAAFEKEIAAFESELQAYKGKGNPEVEALRELAAKIRGDLQAYRHN

SEQ ID NO: 817 - protein, 73 aa, Artificial sequence
  artificial construct
MGSWWEFQVRLRAIQYRLNALGGSEAELAAFEKEIAAFESELQAYKGKGNPEVEYLRGLAAQIRFDLQAYRHN

SEQ ID NO: 818 - protein, 73 aa, Artificial sequence
  artificial construct
MGSWWEFKIRLYAIEYRLNALGGSEAELAAFEKEIAAFESELQAYKGKGNPEVEALRAKAAQIRYNLQAYRHN

SEQ ID NO: 819 - protein, 73 aa, Artificial sequence
  artificial construct
MGSWFEFNIRLHAIEYRLKALGGSEAELAAFEKEIAAFESELQAYKGKGNPEVEELRNYAASIRKLLQAYRHN

SEQ ID NO: 820 - protein, 73 aa, Artificial sequence
  artificial construct
MGSWFEFEIRLRAIEYRLSALGGSEAELAAFEKEIAAFESELQAYKGKGNPEVEKLRELAAEIRYALQAYRHN

SEQ ID NO: 821 - protein, 73 aa, Artificial sequence
  artificial construct
MGSWFEFKIRLYAIQYRLSALGGSEAELAAFEKEIAAFESELQAYKGKGNPEVEELRNLAAEIRHSLQAYRHN

SEQ ID NO: 822 - protein, 73 aa, Artificial sequence
  artificial construct
MGSWWEFKVRLRAIEYRLSALGGSEAELAAFEKEIAAFESELQAYKGKGNPEVEELRVLAASIRIHLQAYRHN

SEQ ID NO: 823 - protein, 73 aa, Artificial sequence
  artificial construct
MGSWSEFWFRLHAILYRLQALGGSEAELAAFEKEIAAFESELQAYKGKGNPEVETLRDAAAEIRVALQAYRHN

SEQ ID NO: 824 - protein, 73 aa, Artificial sequence
  artificial construct
MGSWIEFWVRLNAILYRLYALGGSEAELAAFEKEIAAFESELQAYKGKGNPEVEALRDSAAEIRRWLQAYRHN

SEQ ID NO: 825 - protein, 73 aa, Artificial sequence
  artificial construct
MGSWVEFWIRLNAIKYRLLALGGSEAELAAFEKEIAAFESELQAYKGKGNPEVEKLRQDAADIRELLQAYRHN

SEQ ID NO: 826 - protein, 73 aa, Artificial sequence
  artificial construct
MGSWTEFWWRLSAIVYRLNALGGSEAELAAFEKEIAAFESELQAYKGKGNPEVEELRDMAADIRSLLQAYRHN

SEQ ID NO: 827 - protein, 73 aa, Artificial sequence
  artificial construct
MGSWWEFYLRLRAISYRLQALGGSEAELAAFEKEIAAFESELQAYKGKGNPEVEGLRQDAAEIRKLLQAYRHN

SEQ ID NO: 828 - protein, 73 aa, Artificial sequence
  artificial construct
MGSWWEFHVRLRAIEYRLEALGGSEAELAAFEKEIAAFESELQAYKGKGNPEVEQLRLIAANIRHLLQAYRHN

SEQ ID NO: 829 - protein, 73 aa, Artificial sequence
  artificial construct
MGSWWEFHVRLKAIEYRLLALGGSEAELAAFEKEIAAFESELQAYKGKGNPEVEDLRYIAANIRQLLQAYRHN

SEQ ID NO: 830 - protein, 73 aa, Artificial sequence
  artificial construct
MGSWWEFKVRLKAIEYRLLALGGSEAELAAFEKEIAAFESELQAYKGKGNPEVEDLRYIAANIRQLLQAYRHN

SEQ ID NO: 831 - protein, 73 aa, Artificial sequence
  artificial construct
MGSWWEFQVRLAAIEYRLKALGGSEAELAAFEKEIAAFESELQAYKGKGNPEVENLRQLAAHIRSVLQAYRHN

SEQ ID NO: 832 - protein, 73 aa, Artificial sequence
  artificial construct
MGSWWEFQVRLSAIEYRLTALGGSEAELAAFEKEIAAFESELQAYKGKGNPEVEELRQKAARIRSLLQAYRHN

SEQ ID NO: 833 - protein, 73 aa, Artificial sequence
  artificial construct
MGSWWEFNIRLHAIDYRLKALGGSEAELAAFEKEIAAFESELQAYKGKGNPEVELLREKAAQIRAQLQAYRHN

SEQ ID NO: 834 - protein, 73 aa, Artificial sequence
  artificial construct
MGSWWEFRVRLEAIDYRLKALGGSEAELAAFEKEIAAFESELQAYKGKGNPEVEYLRMKAATIRAILQAYRHN

SEQ ID NO: 835 - protein, 73 aa, Artificial sequence
  artificial construct
MGSWYEFDIRLEAIKYRLSALGGSEAELAAFEKEIAAFESELQAYKGKGNPEVEYLRKKAAVIRSMLQAYRHN

SEQ ID NO: 836 - protein, 73 aa, Artificial sequence
  artificial construct
MGSWWEFRIRLEAIWYRLHALGGSEAELAAFEKEIAAFESELQAYKGKGNPEVEDLRIFAANIRSKLQAYRHN

SEQ ID NO: 837 - protein, 73 aa, Artificial sequence
  artificial construct
MGSWWEFNVRLQAIKYRLSALGGSEAELAAFEKEIAAFESELQAYKGKGNPEVEDLRKTAAHIRWQLQAYRHN

SEQ ID NO: 838 - protein, 73 aa, Artificial sequence
  artificial construct
MGSWWEFNVRLSAIRYRLLALGGSEAELAAFEKEIAAFESELQAYKGKGNPEVEDLRASAAQIRAMLQAYRHN

SEQ ID NO: 839 - protein, 73 aa, Artificial sequence
  artificial construct
MGSWWEFNMRLSAIKYRLYALGGSEAELAAFEKEIAAFESELQAYKGKGNPEVEILRRLAADIRERLQAYRHN

SEQ ID NO: 840 - protein, 73 aa, Artificial sequence
  artificial construct
MGSWWEFHIRLRAIKYRLYALGGSEAELAAFEKEIAAFESELQAYKGKGNPEVEDLRILAAEIRAQLQAYRHN

SEQ ID NO: 841 - protein, 73 aa, Artificial sequence
  artificial construct
MGSWVEFYERLDAIDRRLWALGGSEAELAAFEKEIAAFESELQAYKGKGNPEVEELRVHAASIRAWLQAYRHN

SEQ ID NO: 842 - protein, 73 aa, Artificial sequence
  artificial construct
MGSWFEFYDRLNAIDARLWALGGSEAELAAFEKEIAAFESELQAYKGKGNPEVESLRAHAAAIREWLQAYRHN

SEQ ID NO: 843 - protein, 73 aa, Artificial sequence
  artificial construct
MGSWSEFYDRLNAIDARLWALGGSEAELAAFEKEIAAFESELQAYKGKGNPEVESLRVHAAAIREWLQAYRHN

SEQ ID NO: 844 - protein, 73 aa, Artificial sequence
  artificial construct
MGSWSEFYDRLNAIDARLWALGGSEAELAAFEKEIAAFESELQAYKGKGNPEVESLRAHAAAIREWLQAYRHN

SEQ ID NO: 845 - protein, 73 aa, Artificial sequence
  artificial construct
MGSWSEFYDRLNAIDARLWALGGSEAELAAFEKEIAAFESELQAYKGKGNPEVESLKAHAAAIREWLQAYRHN

SEQ ID NO: 846 - protein, 73 aa, Artificial sequence
  artificial construct
MGSWSEFYDRLNAIDARLWALGGSEAELAAFEKEIAAFESELQAYKGKGNPEVESLQAHAAAIREWLQAYRHN

SEQ ID NO: 847 - protein, 73 aa, Artificial sequence
  artificial construct
MGSWSEFYDRLNAIDARLWALGGSEAELAAFEKEIAAFESELQAYKGKGNPEVESLRAHAAGIREWLQAYRHN

SEQ ID NO: 848 - protein, 73 aa, Artificial sequence
  artificial construct
MGSWFEFYDRLNAIDARLWALGGSEAELAAFEKEIAAFESELQAYKGKGNPEVESLREHAAHIREWLQAYRHN

SEQ ID NO: 849 - protein, 73 aa, Artificial sequence
  artificial construct
MGSWFEFYDRLNAIDARLWALGGSEAELAAFEKEIAAFESELQAYKGKGNPEVESLREHAAAIREWLQAYRHN

SEQ ID NO: 850 - protein, 73 aa, Artificial sequence
  artificial construct
MGSWSEFYDRLNAIDARLWALGGSEAELAAFEKEIAAFESELQAYKGKGNPEVESLREHAAAIREWLQAYRHN

SEQ ID NO: 851 - protein, 73 aa, Artificial sequence
  artificial construct
MGSWHEFYDRLDAIYFRLWALGGSEAELAAFEKEIAAFESELQAYKGKGNPEVELLRLLAAEIRKELQAYRHN

SEQ ID NO: 852 - protein, 73 aa, Artificial sequence
  artificial construct
MGSWHEFITRLEAIDQRLWALGGSEAELAAFEKEIAAFESELQAYKGKGNPEVEYLRFWAAEIRFILQAYRHN

SEQ ID NO: 853 - protein, 73 aa, Artificial sequence
  artificial construct
MGSWMEFFDRLVAIDERLWALGGSEAELAAFEKEIAAFESELQAYKGKGNPEVEYLRMWAAEIRFLLQAYRHN

SEQ ID NO: 854 - protein, 73 aa, Artificial sequence
  artificial construct
MGSWVEFSGRLIAIDNRLWALGGSEAELAAFEKEIAAFESELQAYKGKGNPEVEYLRMWAAEIRYILQAYRHN

SEQ ID NO: 855 - protein, 73 aa, Artificial sequence
  artificial construct
MGSWVEFHHRLFAIDERLWALGGSEAELAAFEKEIAAFESELQAYKGKGNPEVEYLRMVAAEIRYILQAYRHN

SEQ ID NO: 856 - protein, 73 aa, Artificial sequence
  artificial construct
MGSWHEFMERLIAIDGRLWALGGSEAELAAFEKEIAAFESELQAYKGKGNPEVEYLRFVAAFIRDVLQAYRHN

SEQ ID NO: 857 - protein, 73 aa, Artificial sequence
  artificial construct
MGSWKEFIQRLDAIHYRLWALGGSEAELAAFEKEIAAFESELQAYKGKGNPEVEYLRFVAAFIRFELQAYRHN

SEQ ID NO: 858 - protein, 73 aa, Artificial sequence
  artificial construct
MGSWSEFIFRLDAIHSRLQALGGSEAELAAFEKEIAAFESELQAYKGKGNPEVEYLRFIAAEIRLKLQAYRHN

SEQ ID NO: 859 - protein, 73 aa, Artificial sequence
  artificial construct
MGSWFEFYDRLNAIDARLWALGGSEAELAAFEKEIAAFESELQAYKGKGNPEVENLRVHAAAIREWLQAYRHN

SEQ ID NO: 860 - protein, 73 aa, Artificial sequence
  artificial construct
MGSWLEFYDRLNAIDARLWALGGSEAELAAFEKEIAAFESELQAYKGKGNPEVENLRVHAAAIREWLQAYRHN

SEQ ID NO: 861 - protein, 73 aa, Artificial sequence
  artificial construct
MGSWFEFYHRLNAIDARLWALGGSEAELAAFEKEIAAFESELQAYKGKGNPEVENLRVHAAAIREWLQAYRHN

SEQ ID NO: 862 - protein, 73 aa, Artificial sequence
  artificial construct
MGSWFEFYDRLNAIDSRLWALGGSEAELAAFEKEIAAFESELQAYKGKGNPEVENLRVHAAAIREWLQAYRHN

SEQ ID NO: 863 - protein, 73 aa, Artificial sequence
  artificial construct
MGSWFEFYDRLNAIDARLWALGGSEAELAAFEKEIAAFESELQAYKGKGNPEVESLRVHAAAIREWLQAYRHN

SEQ ID NO: 864 - protein, 73 aa, Artificial sequence
  artificial construct
MGSWFEFYDRLNAIDARLWALGGSEAELAAFEKEIAAFESELQAYKGKGNPEVENLRDHAAAIREWLQAYRHN

SEQ ID NO: 865 - protein, 73 aa, Artificial sequence
  artificial construct
MGSWFEFYDRLNAIDARLWALGGSEAELAAFEKEIAAFESELQAYKGKGNPEVENLREHAAAIREWLQAYRHN

SEQ ID NO: 866 - protein, 73 aa, Artificial sequence
  artificial construct
MGSWFEFYDRLNAIDARLWALGGSEAELAAFEKEIAAFESELQAYKGKGNPEVENLRVHAAHIREWLQAYRHN

SEQ ID NO: 867 - protein, 73 aa, Artificial sequence
  artificial construct
MGSWLEFYHRLNAIDSRLWALGGSEAELAAFEKEIAAFESELQAYKGKGNPEVENLRVHAAAIREWLQAYRHN

SEQ ID NO: 868 - protein, 73 aa, Artificial sequence
  artificial construct
MGSWLEFYHRLNAIDSRLWALGGSEAELAAFEKEIAAFESELQAYKGKGNPEVESLRDHAAHIREWLQAYRHN

SEQ ID NO: 869 - protein, 73 aa, Artificial sequence
  artificial construct
MGSWFEFYHRLNAIDSRLWALGGSEAELAAFEKEIAAFESELQAYKGKGNPEVESLRDHAAHIREWLQAYRHN

SEQ ID NO: 870 - protein, 73 aa, Artificial sequence
  artificial construct
MGSWLEFYDRLNAIDSRLWALGGSEAELAAFEKEIAAFESELQAYKGKGNPEVESLRDHAAHIREWLQAYRHN

SEQ ID NO: 871 - protein, 73 aa, Artificial sequence
  artificial construct
MGSWLEFYHRLNAIDARLWALGGSEAELAAFEKEIAAFESELQAYKGKGNPEVESLRDHAAHIREWLQAYRHN

SEQ ID NO: 872 - protein, 73 aa, Artificial sequence
  artificial construct
MGSWLEFYHRLNAIDSRLWALGGSEAELAAFEKEIAAFESELQAYKGKGNPEVENLRDHAAHIREWLQAYRHN

SEQ ID NO: 873 - protein, 73 aa, Artificial sequence
  artificial construct
MGSWLEFYHRLNAIDSRLWALGGSEAELAAFEKEIAAFESELQAYKGKGNPEVESLRVHAAHIREWLQAYRHN

SEQ ID NO: 874 - protein, 73 aa, Artificial sequence
  artificial construct
MGSWLEFYHRLNAIDSRLWALGGSEAELAAFEKEIAAFESELQAYKGKGNPEVESLRDHAAAIREWLQAYRHN

SEQ ID NO: 875 - protein, 73 aa, Artificial sequence
  artificial construct
MGSWFEFYDRLNAIDARLWALGGSEAELAAFEKEIAAFESELQAYKGKGNPEVESLRDHAAHIREWLQAYRHN

SEQ ID NO: 876 - protein, 73 aa, Artificial sequence
  artificial construct
MGSWFEFYERLNAIDSRLWALGGSEAELAAFEKEIAAFESELQAYKGKGNPEVEKLRAHAASIRTWLQAYRHN

SEQ ID NO: 877 - protein, 73 aa, Artificial sequence
  artificial construct
MGSWIEFYWRLEAIDQRLWALGGSEAELAAFEKEIAAFESELQAYKGKGNPEVEDLRVHAAAIRWWLQAYRHN

SEQ ID NO: 878 - protein, 73 aa, Artificial sequence
  artificial construct
MGSWSEFVKRLDAIDQRLWALGGSEAELAAFEKEIAAFESELQAYKGKGNPEVESLRVHAAAIRAWLQAYRHN

SEQ ID NO: 879 - protein, 73 aa, Artificial sequence
  artificial construct
MGSWEEFYYRLEAIDARLFALGGSEAELAAFEKEIAAFESELQAYKGKGNPEVEELRVHAAHIRDWLQAYRHN

SEQ ID NO: 880 - protein, 73 aa, Artificial sequence
  artificial construct
MGSWVEFHYRLQAIDARLWALGGSEAELAAFEKEIAAFESELQAYKGKGNPEVEELRVHAAHIRKWLQAYRHN

SEQ ID NO: 881 - protein, 73 aa, Artificial sequence
  artificial construct
MGSWVEFVGRLNAIDARLWALGGSEAELAAFEKEIAAFESELQAYKGKGNPEVEELRHHAAEIRNWLQAYRHN

SEQ ID NO: 882 - protein, 73 aa, Artificial sequence
  artificial construct
MGSWNEFMDRLNAIDNRLWALGGSEAELAAFEKEIAAFESELQAYKGKGNPEVENLRKQAASIRLWLQAYRHN

SEQ ID NO: 883 - protein, 73 aa, Artificial sequence
  artificial construct
MGSWNEFFQRLNAIDERLWALGGSEAELAAFEKEIAAFESELQAYKGKGNPEVEDLRQHAANIRWWLQAYRHN

SEQ ID NO: 884 - protein, 73 aa, Artificial sequence
  artificial construct
MGSWYEFVVRLFAIDERLWALGGSEAELAAFEKEIAAFESELQAYKGKGNPEVESLREHAAHIRSWLQAYRHN

SEQ ID NO: 885 - protein, 73 aa, Artificial sequence
  artificial construct
MGSWYEFYLRLDAIDHRLWALGGSEAELAAFEKEIAAFESELQAYKGKGNPEVEMLREHAAHIRKWLQAYRHN

SEQ ID NO: 886 - protein, 73 aa, Artificial sequence
  artificial construct
MGSWYEFRARLLAIDERLWALGGSEAELAAFEKEIAAFESELQAYKGKGNPEVEHLREHAAHIRNFLQAYRHN

SEQ ID NO: 887 - protein, 73 aa, Artificial sequence
  artificial construct
MGSWTEFWHRLEAIDSRLWALGGSEAELAAFEKEIAAFESELQAYKGKGNPEVESLREHAAHIRVWLQAYRHN

SEQ ID NO: 888 - protein, 73 aa, Artificial sequence
  artificial construct
MGSWTEFQNRLNAIDHRLWALGGSEAELAAFEKEIAAFESELQAYKGKGNPEVESLREHAAKIRVWLQAYRHN

SEQ ID NO: 889 - protein, 73 aa, Artificial sequence
  artificial construct
MGSWSEFFKRLEAIDRRLWALGGSEAELAAFEKEIAAFESELQAYKGKGNPEVEELREHAAHIRVWLQAYRHN

SEQ ID NO: 890 - protein, 73 aa, Artificial sequence
  artificial construct
MGSWYEFQQRLEAIDTRLWALGGSEAELAAFEKEIAAFESELQAYKGKGNPEVEELREHAAHIRHWLQAYRHN

SEQ ID NO: 891 - protein, 73 aa, Artificial sequence
  artificial construct
MGSWTEFEKRLHAIDYRLWALGGSEAELAAFEKEIAAFESELQAYKGKGNPEVEDLREHAAAIRHWLQAYRHN

SEQ ID NO: 892 - protein, 73 aa, Artificial sequence
  artificial construct
MGSWTEFHQRLDAIDERLWALGGSEAELAAFEKEIAAFESELQAYKGKGNPEVEFLREHAAKIRMWLQAYRHN

SEQ ID NO: 893 - protein, 73 aa, Artificial sequence
  artificial construct
MGSWLEFSQRLTAIDSRLWALGGSEAELAAFEKEIAAFESELQAYKGKGNPEVENLREHAAKIRNWLQAYRHN

SEQ ID NO: 894 - protein, 73 aa, Artificial sequence
  artificial construct
MGSWTEFVNRLYAIDSRLWALGGSEAELAAFEKEIAAFESELQAYKGKGNPEVEGLRTHAAKIRHWLQAYRHN

SEQ ID NO: 895 - protein, 73 aa, Artificial sequence
  artificial construct
MGSWMEFVDRLSAIDRRLWALGGSEAELAAFEKEIAAFESELQAYKGKGNPEVEVLREHAANIRQWLQAYRHN

SEQ ID NO: 896 - protein, 73 aa, Artificial sequence
  artificial construct
MGSWVEFVSRLYAIDFRLWALGGSEAELAAFEKEIAAFESELQAYKGKGNPEVEALREHAAQIRDWLQAYRHN

SEQ ID NO: 897 - protein, 73 aa, Artificial sequence
  artificial construct
MGSWSEFHTRLDAIDTRLWALGGSEAELAAFEKEIAAFESELQAYKGKGNPEVEDLRRHAAAIRFWLQAYRHN

SEQ ID NO: 898 - protein, 73 aa, Artificial sequence
  artificial construct
MGSWLEFHSRLDAIDTRLWALGGSEAELAAFEKEIAAFESELQAYKGKGNPEVEKLREHAAAIRHYLQAYRHN

SEQ ID NO: 899 - protein, 73 aa, Artificial sequence
  artificial construct
MGSWTEFYQRLDAIDTRLWALGGSEAELAAFEKEIAAFESELQAYKGKGNPEVEGLRQQAAQIRAWLQAYRHN

SEQ ID NO: 900 - protein, 73 aa, Artificial sequence
  artificial construct
MGSWAEFSDRLNAIDQRLWALGGSEAELAAFEKEIAAFESELQAYKGKGNPEVEILREHAAEIRKFLQAYRHN

SEQ ID NO: 901 - protein, 73 aa, Artificial sequence
  artificial construct
MGSWMEFNHRLQAIDGRLWALGGSEAELAAFEKEIAAFESELQAYKGKGNPEVEMLREHAAAIRAFLQAYRHN

SEQ ID NO: 902 - protein, 73 aa, Artificial sequence
  artificial construct
MGSWYEFYKRLEAIDNRLYALGGSEAELAAFEKEIAAFESELQAYKGKGNPEVEYLREHAAAIRHWLQAYRHN

SEQ ID NO: 903 - protein, 73 aa, Artificial sequence
  artificial construct
MGSWYEFYYRLEAIDNRLIALGGSEAELAAFEKEIAAFESELQAYKGKGNPEVEVLREHAAKIREWLQAYRHN

SEQ ID NO: 904 - protein, 73 aa, Artificial sequence
  artificial construct
MGSWYEFVSRLEAIDDRLYALGGSEAELAAFEKEIAAFESELQAYKGKGNPEVEMLRQHAAAIRHWLQAYRHN

SEQ ID NO: 905 - protein, 73 aa, Artificial sequence
  artificial construct
MGSWYEFSHRLEAIEDRLFALGGSEAELAAFEKEIAAFESELQAYKGKGNPEVEPLREHAAYIRHWLQAYRHN

SEQ ID NO: 906 - protein, 73 aa, Artificial sequence
  artificial construct
MGSWFEFFERLAAIEDRLWALGGSEAELAAFEKEIAAFESELQAYKGKGNPEVESLRVHAAAIRAFLQAYRHN

SEQ ID NO: 907 - protein, 73 aa, Artificial sequence
  artificial construct
MGSWIEFKYRLDAIEWRLEALGGSEAELAAFEKEIAAFESELQAYKGKGNPEVESLRIHAAAIRTWLQAYRHN

SEQ ID NO: 908 - protein, 73 aa, Artificial sequence
  artificial construct
MGSWYEFMYRLDAIEYRLFALGGSEAELAAFEKEIAAFESELQAYKGKGNPEVESLRIHAAMIREWLQAYRHN

SEQ ID NO: 909 - protein, 73 aa, Artificial sequence
  artificial construct
MGSWVEFVTRLEAIEDRLFALGGSEAELAAFEKEIAAFESELQAYKGKGNPEVEHLRAHAAHIRHWLQAYRHN

SEQ ID NO: 910 - protein, 73 aa, Artificial sequence
  artificial construct
MGSWYEFVIRLDAIEDRLFALGGSEAELAAFEKEIAAFESELQAYKGKGNPEVEHLRVHAAHIRVWLQAYRHN

SEQ ID NO: 911 - protein, 73 aa, Artificial sequence
  artificial construct
MGSWVEFVERLDAIEFRLFALGGSEAELAAFEKEIAAFESELQAYKGKGNPEVEKLRNHAAHIRSWLQAYRHN

SEQ ID NO: 912 - protein, 73 aa, Artificial sequence
  artificial construct
MGSWSEFVHRLDAIEVRLFALGGSEAELAAFEKEIAAFESELQAYKGKGNPEVEELRYHAAKIRSWLQAYRHN

SEQ ID NO: 913 - protein, 73 aa, Artificial sequence
  artificial construct
MGSWSEFYYRLAAIESRLFALGGSEAELAAFEKEIAAFESELQAYKGKGNPEVERLREHAAHIRRWLQAYRHN

SEQ ID NO: 914 - protein, 73 aa, Artificial sequence
  artificial construct
MGSWYEFYLRLSAIEDRLFALGGSEAELAAFEKEIAAFESELQAYKGKGNPEVESLRVQAAHIRTWLQAYRHN

SEQ ID NO: 915 - protein, 73 aa, Artificial sequence
  artificial construct
MGSWYEFYDRLDAIEDRLFALGGSEAELAAFEKEIAAFESELQAYKGKGNPEVESLRDQAAYIRTWLQAYRHN

SEQ ID NO: 916 - protein, 73 aa, Artificial sequence
  artificial construct
MGSWHEFWVRLEAIESRLFALGGSEAELAAFEKEIAAFESELQAYKGKGNPEVESLRVQAAHIRSWLQAYRHN

SEQ ID NO: 917 - protein, 73 aa, Artificial sequence
  artificial construct
MGSWVEFYHRLEAIEQRLMALGGSEAELAAFEKEIAAFESELQAYKGKGNPEVESLREQAAAIRSWLQAYRHN

SEQ ID NO: 918 - protein, 73 aa, Artificial sequence
  artificial construct
MGSWVEFYERLNAIEYRLEALGGSEAELAAFEKEIAAFESELQAYKGKGNPEVESLREHAAYIRQWLQAYRHN

SEQ ID NO: 919 - protein, 73 aa, Artificial sequence
  artificial construct
MGSWVEFYHRLDAIFDRLDALGGSEAELAAFEKEIAAFESELQAYKGKGNPEVEELRANAAGIRSWLQAYRHN

SEQ ID NO: 920 - protein, 73 aa, Artificial sequence
  artificial construct
MGSWSEFTDRLFAIEDRLLALGGSEAELAAFEKEIAAFESELQAYKGKGNPEVEDLRMHAASIRLWLQAYRHN

SEQ ID NO: 921 - protein, 73 aa, Artificial sequence
  artificial construct
MGSWHEFYDRLYAIWDRLDALGGSEAELAAFEKEIAAFESELQAYKGKGNPEVEGLRNAAAVIRIFLQAYRHN

SEQ ID NO: 922 - protein, 73 aa, Artificial sequence
  artificial construct
MGSWFEFSNRLYAIWHRLTALGGSEAELAAFEKEIAAFESELQAYKGKGNPEVESLRTQAAFIRILLQAYRHN

SEQ ID NO: 923 - protein, 73 aa, Artificial sequence
  artificial construct
MGSWFEFSDRLYAIWERLDALGGSEAELAAFEKEIAAFESELQAYKGKGNPEVESLRFQAAFIRYQLQAYRHN

SEQ ID NO: 924 - protein, 73 aa, Artificial sequence
  artificial construct
MGSWFEFEDRLFAIWTRLEALGGSEAELAAFEKEIAAFESELQAYKGKGNPEVESLRQSAASIRWLLQAYRHN

SEQ ID NO: 925 - protein, 73 aa, Artificial sequence
  artificial construct
MGSWHEFSERLFAIWTRLEALGGSEAELAAFEKEIAAFESELQAYKGKGNPEVEALRQSAAFIRVMLQAYRHN

SEQ ID NO: 926 - protein, 73 aa, Artificial sequence
  artificial construct
MGSWGEFTVRLYAIDRRLDALGGSEAELAAFEKEIAAFESELQAYKGKGNPEVEELRRFAAIIRAFLQAYRHN

SEQ ID NO: 927 - protein, 73 aa, Artificial sequence
  artificial construct
MGSWYEFDHRLMAISFRLVALGGSEAELAAFEKEIAAFESELQAYKGKGNPEVETLRRRAANIRHLLQAYRHN

SEQ ID NO: 928 - protein, 73 aa, Artificial sequence
  artificial construct
MGSWSIFKYHLADIKLLLEALGGSEAELAYFEFLIADFEFTLQDYKGKGNPEVEALRKEAAAIRDELQAYRHN

SEQ ID NO: 929 - protein, 73 aa, Artificial sequence
  artificial construct
MGSWHHFKYFLADIKSILEALGGSEAELAIFEVQIAYFEDLLQSYKGKGNPEVEALRKEAAAIRDELQAYRHN

SEQ ID NO: 930 - protein, 73 aa, Artificial sequence
  artificial construct
MGSWLYFKYNLAVIKHWLEALGGSEAELAIFEMSIADFEYELQWYKGKGNPEVEALRKEAAAIRDELQAYRHN

SEQ ID NO: 931 - protein, 73 aa, Artificial sequence
  artificial construct
MGSWFYFKYELAWIKHWLEALGGSEAELASFETHIAFFEHQLQYYKGKGNPEVEALRKEAAAIRDELQAYRHN

SEQ ID NO: 932 - protein, 73 aa, Artificial sequence
  artificial construct
MGSWADFKWTLAYIKHRLEALGGSEAELAFFEMEIAYFEQSLQNYKGKGNPEVEALRKEAAAIRDELQAYRHN

SEQ ID NO: 933 - protein, 73 aa, Artificial sequence
  artificial construct
MGSWAYFKGQLAYIKSGLEALGGSEAELAYFELRIAYFEHWLQNYKGKGNPEVEALRKEAAAIRDELQAYRHN

SEQ ID NO: 934 - protein, 73 aa, Artificial sequence
  artificial construct
MGSWENFKDTLAWIKEYLEALGGSEAELAGFEHRIAIFEHYLQYYKGKGNPEVEALRKEAAAIRDELQAYRHN

SEQ ID NO: 935 - protein, 73 aa, Artificial sequence
  artificial construct
MGSWVLFKDYLADIKHYLEALGGSEAELANFEHLIANFEGDLQTYKGKGNPEVEALRKEAAAIRDELQAYRHN

SEQ ID NO: 936 - protein, 73 aa, Artificial sequence
  artificial construct
MGSWSLFKHRLANIKVYLEALGGSEAELADFETFIAYFEKDLQEYKGKGNPEVEALRKEAAAIRDELQAYRHN

SEQ ID NO: 937 - protein, 73 aa, Artificial sequence
  artificial construct
MGSWEHFKVELAGIKAYLEALGGSEAELALFEWAIADFESILQDYKGKGNPEVEALRKEAAAIRDELQAYRHN

SEQ ID NO: 938 - protein, 73 aa, Artificial sequence
  artificial construct
MGSWIYFKDELAGIKKYLEALGGSEAELAMFEVAIADFEAILQKYKGKGNPEVEALRKEAAAIRDELQAYRHN

SEQ ID NO: 939 - protein, 73 aa, Artificial sequence
  artificial construct
MGSWVLFKQELAWIKWLLEALGGSEAELAAFEEQIARFEHDLQKYKGKGNPEVEALRKEAAAIRDELQAYRHN

SEQ ID NO: 940 - protein, 73 aa, Artificial sequence
  artificial construct
MGSWVLFKQELAWIKWYLEALGGSEAELAAFEWEIAAFEQRLQIYKGKGNPEVEALRKEAAAIRDELQAYRHN

SEQ ID NO: 941 - protein, 73 aa, Artificial sequence
  artificial construct
MGSWFLFKSELAWIKWRLEALGGSEAELAYFEYQIAEFEFWLQSYKGKGNPEVEALRKEAAAIRDELQAYRHN

SEQ ID NO: 942 - protein, 73 aa, Artificial sequence
  artificial construct
MGSWLLFKSELAWIKWYLEALGGSEAELAEFEWNIAEFEKNLQKYKGKGNPEVEALRKEAAAIRDELQAYRHN

SEQ ID NO: 943 - protein, 73 aa, Artificial sequence
  artificial construct
MGSWLLFKSDLAWIKWRLEALGGSEAELAEFEESIAMFEHWLQEYKGKGNPEVEALRKEAAAIRDELQAYRHN

SEQ ID NO: 944 - protein, 73 aa, Artificial sequence
  artificial construct
MGSWLYFKSDLAWIKWRLEALGGSEAELADFEEAIAEFEQALQIYKGKGNPEVEALRKEAAAIRDELQAYRHN

SEQ ID NO: 945 - protein, 73 aa, Artificial sequence
  artificial construct
MGSWKLFKYELAWIKWRLEALGGSEAELADFEASIAQFEKYLQTYKGKGNPEVEALRKEAAAIRDELQAYRHN

SEQ ID NO: 946 - protein, 73 aa, Artificial sequence
  artificial construct
MGSWYLFKNELAWIKWRLEALGGSEAELADFEMVIAMFEDHLQEYKGKGNPEVEALRKEAAAIRDELQAYRHN

SEQ ID NO: 947 - protein, 73 aa, Artificial sequence
  artificial construct
MGSWVYFKAHLAFIKWELEALGGSEAELANFESTIAEFEKYLQVYKGKGNPEVEALRKEAAAIRDELQAYRHN

SEQ ID NO: 948 - protein, 73 aa, Artificial sequence
  artificial construct
MGSWMYFKSHLAWIKWELEALGGSEAELAFFEDNIAQFEYWLQLYKGKGNPEVEALRKEAAAIRDELQAYRHN

SEQ ID NO: 949 - protein, 73 aa, Artificial sequence
  artificial construct
MGSWTLFKWDLAFIKWQLEALGGSEAELAWFEYEIAAFEDSLQNYKGKGNPEVEALRKEAAAIRDELQAYRHN

SEQ ID NO: 950 - protein, 73 aa, Artificial sequence
  artificial construct
MGSWILFKEDLAFIKWQLEALGGSEAELAWFETTIANFESDLQKYKGKGNPEVEALRKEAAAIRDELQAYRHN

SEQ ID NO: 951 - protein, 73 aa, Artificial sequence
  artificial construct
MGSWYFFKSRLAYIKVYLEALGGSEAELAGFEWEIAHFEEWLQRYKGKGNPEVEALRKEAAAIRDELQAYRHN

SEQ ID NO: 952 - protein, 73 aa, Artificial sequence
  artificial construct
MGSWYIFKSELAWIKWYLEALGGSEAELANFEVEIATFETWLQGYKGKGNPEVEALRKEAAAIRDELQAYRHN

SEQ ID NO: 953 - protein, 73 aa, Artificial sequence
  artificial construct
MGSWYIFKQELASIKLSLEALGGSEAELAHFEAEIAWFEWWLQWYKGKGNPEVEALRKEAAAIRDELQAYRHN

SEQ ID NO: 954 - protein, 73 aa, Artificial sequence
  artificial construct
MGSWVRFKTELAYIKESLEALGGSEAELAMFESEIAIFEHSLQTYKGKGNPEVEALRKEAAAIRDELQAYRHN

SEQ ID NO: 955 - protein, 73 aa, Artificial sequence
  artificial construct
MGSWYLFKTELAAIKYRLEALGGSEAELASFEYEIAWFEHILQFYKGKGNPEVEALRKEAAAIRDELQAYRHN

SEQ ID NO: 956 - protein, 73 aa, Artificial sequence
  artificial construct
MGSWYWFKYELAEIKWHLEALGGSEAELAHFEHSIAVFESQLQQYKGKGNPEVEALRKEAAAIRDELQAYRHN

SEQ ID NO: 957 - protein, 73 aa, Artificial sequence
  artificial construct
MGSWWVFKKTLAEIKWTLEALGGSEAELAYFEAEIAFFEFILQQYKGKGNPEVEALRKEAAAIRDELQAYRHN

SEQ ID NO: 958 - protein, 73 aa, Artificial sequence
  artificial construct
MGSWVYFKDHLAEIKSQLEALGGSEAELALFEYDIAWFEFILQYYKGKGNPEVEALRKEAAAIRDELQAYRHN

SEQ ID NO: 959 - protein, 73 aa, Artificial sequence
  artificial construct
MGSWVYFKHRLAEIKDQLEALGGSEAELAEFETDIAWFEWMLQYYKGKGNPEVEALRKEAAAIRDELQAYRHN

SEQ ID NO: 960 - protein, 73 aa, Artificial sequence
  artificial construct
MGSWIIFKTDLARIKNYLEALGGSEAELATFERDIAWFEFMLQIYKGKGNPEVEALRKEAAAIRDELQAYRHN

SEQ ID NO: 961 - protein, 73 aa, Artificial sequence
  artificial construct
MGSWMHFKQDLAEIKGYLEALGGSEAELAIFEMDIAWFEYMLQYYKGKGNPEVEALRKEAAAIRDELQAYRHN

SEQ ID NO: 962 - protein, 73 aa, Artificial sequence
  artificial construct
MGSWQIFKQDLAAIKDYLEALGGSEAELAIFEFDIAWFEHMLQWYKGKGNPEVEALRKEAAAIRDELQAYRHN

SEQ ID NO: 963 - protein, 73 aa, Artificial sequence
  artificial construct
MGSWLAFKEDLAHIKSILEALGGSEAELAEFEHDIAWFEYMLQYYKGKGNPEVEALRKEAAAIRDELQAYRHN

SEQ ID NO: 964 - protein, 73 aa, Artificial sequence
  artificial construct
MGSWFVFKEDLAGIKFILEALGGSEAELAMFETDIAWFEYMLQYYKGKGNPEVEALRKEAAAIRDELQAYRHN

SEQ ID NO: 965 - protein, 73 aa, Artificial sequence
  artificial construct
MGSWTHFKEDLAHIKDRLEALGGSEAELAAFELDIAWFEFMLQYYKGKGNPEVEALRKEAAAIRDELQAYRHN

SEQ ID NO: 966 - protein, 73 aa, Artificial sequence
  artificial construct
MGSWYYFKERLAAIKDRLEALGGSEAELAIFEADIAWFEFMLQYYKGKGNPEVEALRKEAAAIRDELQAYRHN

SEQ ID NO: 967 - protein, 73 aa, Artificial sequence
  artificial construct
MGSWYTFKGSLAEIKNRLEALGGSEAELAMFESDIAWFEFMLQFYKGKGNPEVEALRKEAAAIRDELQAYRHN

SEQ ID NO: 968 - protein, 73 aa, Artificial sequence
  artificial construct
MGSWFTFKDDLAQIKNRLEALGGSEAELANFEMSIAWFEFMLQYYKGKGNPEVEALRKEAAAIRDELQAYRHN

SEQ ID NO: 969 - protein, 73 aa, Artificial sequence
  artificial construct
MGSWVLFKQDLAMIKQRLEALGGSEAELAMFEYDIAWFEHMLQYYKGKGNPEVEALRKEAAAIRDELQAYRHN

SEQ ID NO: 970 - protein, 73 aa, Artificial sequence
  artificial construct
MGSWVEFKRDLANIKQRLEALGGSEAELAQFEMQIAWFEHTLQYYKGKGNPEVEALRKEAAAIRDELQAYRHN

SEQ ID NO: 971 - protein, 73 aa, Artificial sequence
  artificial construct
MGSWSYFKEDLANIKSSLEALGGSEAELAWFESSIAWFEHTLQYYKGKGNPEVEALRKEAAAIRDELQAYRHN

SEQ ID NO: 972 - protein, 73 aa, Artificial sequence
  artificial construct
MGSWSIFKQDLADIKDSLEALGGSEAELAMFEMDIAWFEHTLQYYKGKGNPEVEALRKEAAAIRDELQAYRHN

SEQ ID NO: 973 - protein, 73 aa, Artificial sequence
  artificial construct
MGSWEIFKDDLASIKKVLEALGGSEAELALFESDIAWFELMLQYYKGKGNPEVEALRKEAAAIRDELQAYRHN

SEQ ID NO: 974 - protein, 73 aa, Artificial sequence
  artificial construct
MGSWSIFKDDLAVIKERLEALGGSEAELAHFEQDIAWFEHLLQYYKGKGNPEVEALRKEAAAIRDELQAYRHN

SEQ ID NO: 975 - protein, 73 aa, Artificial sequence
  artificial construct
MGSWSVFKDDLAQIKDRLEALGGSEAELAQFELDIAWFEYVLQFYKGKGNPEVEALRKEAAAIRDELQAYRHN

SEQ ID NO: 976 - protein, 73 aa, Artificial sequence
  artificial construct
MGSWAVFKDSLAHIKDVLEALGGSEAELALFEMDIAWFEYVLQDYKGKGNPEVEALRKEAAAIRDELQAYRHN

SEQ ID NO: 977 - protein, 73 aa, Artificial sequence
  artificial construct
MGSWIAFKDHLAIIKQRLEALGGSEAELARFEFEIAWFEWMLQYYKGKGNPEVEALRKEAAAIRDELQAYRHN

SEQ ID NO: 978 - protein, 73 aa, Artificial sequence
  artificial construct
MGSWIHFKNDLAVIKDELEALGGSEAELARFEIMIAWFEDALQWYKGKGNPEVEALRKEAAAIRDELQAYRHN

SEQ ID NO: 979 - protein, 73 aa, Artificial sequence
  artificial construct
MGSWMVFKQDLAEIKANLEALGGSEAELADFEFAIAWFEYELQWYKGKGNPEVEALRKEAAAIRDELQAYRHN

SEQ ID NO: 980 - protein, 73 aa, Artificial sequence
  artificial construct
MGSWKNFKLELALIKSKLEALGGSEAELAQFEADIAFFEWSLQWYKGKGNPEVEALRKEAAAIRDELQAYRHN

SEQ ID NO: 981 - protein, 73 aa, Artificial sequence
  artificial construct
MGSWHSFKQDLAYIKYLLEALGGSEAELAQFEELIAFFEYYLQTYKGKGNPEVEALRKEAAAIRDELQAYRHN

SEQ ID NO: 982 - protein, 73 aa, Artificial sequence
  artificial construct
MGSWVVFKSSLAQIKILLEALGGSEAELAIFEVKIAHFEQELQEYKGKGNPEVEALRKEAAAIRDELQAYRHN

SEQ ID NO: 983 - protein, 73 aa, Artificial sequence
  artificial construct
MGSWDQFKNSLASIKRVLEALGGSEAELAIFEVKIAHFEHFLQQYKGKGNPEVEALRKEAAAIRDELQAYRHN

SEQ ID NO: 984 - protein, 73 aa, Artificial sequence
  artificial construct
MGSWNNFKSSLASIKQVLEALGGSEAELAVFELQIAHFERELQYYKGKGNPEVEALRKEAAAIRDELQAYRHN

SEQ ID NO: 985 - protein, 73 aa, Artificial sequence
  artificial construct
MGSWVEFGHRLWAIDQRLYALGGSEAELAAFEKEIAAFESELQAYKGKGNPEVEKLRQRAAFIRFRLQAYRHN

SEQ ID NO: 986 - protein, 73 aa, Artificial sequence
  artificial construct
MGSWVEFANRLWAIDQRLFALGGSEAELAAFEKEIAAFESELQAYKGKGNPEVEHLRDQAAFIRHKLQAYRHN

SEQ ID NO: 987 - protein, 73 aa, Artificial sequence
  artificial construct
MGSWYEFRHRLWAIDQRLYALGGSEAELAAFEKEIAAFESELQAYKGKGNPEVEGLREAAAFIRAKLQAYRHN

SEQ ID NO: 988 - protein, 73 aa, Artificial sequence
  artificial construct
MGSWYEFSMRLWAIDQRLYALGGSEAELAAFEKEIAAFESELQAYKGKGNPEVEALRAKAAYIRWKLQAYRHN

SEQ ID NO: 989 - protein, 73 aa, Artificial sequence
  artificial construct
MGSWYEFGHRLWAIDQRLYALGGSEAELAAFEKEIAAFESELQAYKGKGNPEVEYLRETAAHIRTRLQAYRHN

SEQ ID NO: 990 - protein, 73 aa, Artificial sequence
  artificial construct
MGSWYEFHYRLHAIDQRLYALGGSEAELAAFEKEIAAFESELQAYKGKGNPEVEELRIKAAFIRDRLQAYRHN

SEQ ID NO: 991 - protein, 73 aa, Artificial sequence
  artificial construct
MGSWAEFKQRLAAIKTRLEALGGSEAELAAFLGEIWAFEMELAAYKGKGNPEVEALGREAAAIRMELQAYRHN

SEQ ID NO: 992 - protein, 73 aa, Artificial sequence
  artificial construct
MGSWYEFDLRLHAIYDRLVALGGSEAELAAFEKEIAAFESELQAYKGKGNPEVEILRDNAAYIRQMLQAYRHN

SEQ ID NO: 993 - protein, 73 aa, Artificial sequence
  artificial construct
MGSWTEFTYRLSAIEWRLWALGGSEAELAWFEQKIAFFEDFLQYYKGKGNPEVEALKHEAGAILNELMAYRHN

SEQ ID NO: 994 - protein, 73 aa, Artificial sequence
  artificial construct
MGSWAEFDHRLHAIRERLHALGGSEAELAAFEKEIAAFESELQAYKGKGNPEVEILRGNAAYIRALLQAYRHN

SEQ ID NO: 995 - protein, 73 aa, Artificial sequence
  artificial construct
MGSWTEFVGRLAAIEFRLWALGGSEAELAWFEAHIAFFEDYLQWYKGKGNPEVEALREEAGAIMEELKAYRHN

SEQ ID NO: 996 - protein, 73 aa, Artificial sequence
  artificial construct
MGSWTEFYSRLEAIWVRLQALGGSEAELAMFEDRIAHFEWFLQQYKGKGNPEVEALHEEAIAIRKELAAYRHN

SEQ ID NO: 997 - protein, 73 aa, Artificial sequence
  artificial construct
MGSWHEFHDRLQAIHERLYALGGSEAELAAFEKEIAAFESELQAYKGKGNPEVESLRIAAAHIRQVLQAYRHN

SEQ ID NO: 998 - protein, 73 aa, Artificial sequence
  artificial construct
MGSWNYFKDHLAWIKNSLEALGGSEAELAHFETAIASFERQLQEYKGKGNPEVEALRKEAAAIRDELQAYRHN

SEQ ID NO: 999 - protein, 73 aa, Artificial sequence
  artificial construct
MGSWLYFKEHLAHIKAWLEALGGSEAELAHFELAIADFEYHLQEYKGKGNPEVEALRKEAAAIRDELQAYRHN

SEQ ID NO: 1000 - protein, 73 aa, Artificial sequence
  artificial construct
MGSWVYFKEHLAWIKTELEALGGSEAELAHFEHSIADFEMSLQFYKGKGNPEVEALRKEAAAIRDELQAYRHN

SEQ ID NO: 1001 - protein, 73 aa, Artificial sequence
  artificial construct
MGSWFYFKQHLAWIKSYLEALGGSEAELAHFERAIAAFEQHLQMYKGKGNPEVEALRKEAAAIRDELQAYRHN

SEQ ID NO: 1002 - protein, 73 aa, Artificial sequence
  artificial construct
MGSWHYFKDHLAEIKGLLEALGGSEAELAHFEMAIADFEHNLQYYKGKGNPEVEALRKEAAAIRDELQAYRHN

SEQ ID NO: 1003 - protein, 73 aa, Artificial sequence
  artificial construct
MGSWHYFKGHLAEIKNHLEALGGSEAELAHFERAIAAFERSLQWYKGKGNPEVEALRKEAAAIRDELQAYRHN

SEQ ID NO: 1004 - protein, 73 aa, Artificial sequence
  artificial construct
MGSWIYFKEHLAYIKKELEALGGSEAELAHFESAIAVFESTLQYYKGKGNPEVEALRKEAAAIRDELQAYRHN

SEQ ID NO: 1005 - protein, 73 aa, Artificial sequence
  artificial construct
MGSWTYFKEHLAEIKYMLEALGGSEAELAHFEVAIADFEKMLQYYKGKGNPEVEALRKEAAAIRDELQAYRHN

SEQ ID NO: 1006 - protein, 73 aa, Artificial sequence
  artificial construct
MGSWWLFKDHLAEIKTALEALGGSEAELAHFEMAIAAFEKQLQYYKGKGNPEVEALRKEAAAIRDELQAYRHN

SEQ ID NO: 1007 - protein, 73 aa, Artificial sequence
  artificial construct
MGSWSEFYNRLDAIESRLLALGGSEAELALFEIQIARFEKVLQAYKGKGNPEVEALRGEARAIFAELYAYRHN

SEQ ID NO: 1008 - protein, 73 aa, Artificial sequence
  artificial construct
MGSWYEFYNRLYAIEIRLYALGGSEAELAAFEKEIAAFESELQAYKGKGNPEVERLRVRAAKIRVILQAYRHN

SEQ ID NO: 1009 - protein, 73 aa, Artificial sequence
  artificial construct
MGSWLWFKIFLAEIKYFLEALGGSEAELAAFDFEIHAFHVELFAYKGKGNPEVEVLREVAAEIRWDLQAYRHN

SEQ ID NO: 1010 - protein, 73 aa, Artificial sequence
  artificial construct
MGSWTEFQSRLDAIHSRLRALGGSEAELAAFEKEIAAFESELQAYKGKGNPEVELLRDDAAFIRHFLQAYRHN

SEQ ID NO: 1011 - protein, 73 aa, Artificial sequence
  artificial construct
MGSWQEFDDRLNAIKARLQALGGSEAELAAFEKEIAAFESELQAYKGKGNPEVEDLRDDAAFIRRFLQAYRHN

SEQ ID NO: 1012 - protein, 73 aa, Artificial sequence
  artificial construct
MGSWYEFQNRLHAIHERLNALGGSEAELAAFEKEIAAFESELQAYKGKGNPEVELLRDDAAFIRHFLQAYRHN

SEQ ID NO: 1013 - protein, 73 aa, Artificial sequence
  artificial construct
MGSWFEFQDRLTAINERLSALGGSEAELAAFEKEIAAFESELQAYKGKGNPEVETLRSDAAFIRRFLQAYRHN

SEQ ID NO: 1014 - protein, 73 aa, Artificial sequence
  artificial construct
MGSWYEFESRLDAIHERLHALGGSEAELAAFEKEIAAFESELQAYKGKGNPEVENLRGDAAFIRHFLQAYRHN

SEQ ID NO: 1015 - protein, 73 aa, Artificial sequence
  artificial construct
MGSWYEFNHRLDAISKRLNALGGSEAELAAFEKEIAAFESELQAYKGKGNPEVEELRGDAAFIRHFLQAYRHN

SEQ ID NO: 1016 - protein, 73 aa, Artificial sequence
  artificial construct
MGSWFEFENRLHAIVHRLGALGGSEAELAAFEKEIAAFESELQAYKGKGNPEVETLRADAAFIRHYLQAYRHN

SEQ ID NO: 1017 - protein, 73 aa, Artificial sequence
  artificial construct
MGSWVVFKVDLATIKYILEALGGSEAELAEFEGEIAGFEYSLQFYKGKGNPEVEALRKEAAAIRDELQAYRHN

SEQ ID NO: 1018 - protein, 73 aa, Artificial sequence
  artificial construct
MGSWTIFKEWLAFIKTDLEALGGSEAELAFFEGWIASFEMELQKYKGKGNPEVEALRKEAAAIRDELQAYRHN

SEQ ID NO: 1019 - protein, 73 aa, Artificial sequence
  artificial construct
MGSWVMFKWLLADIKSHLEALGGSEAELAFFEGFIAAFETHLQVYKGKGNPEVEALRKEAAAIRDELQAYRHN

SEQ ID NO: 1020 - protein, 73 aa, Artificial sequence
  artificial construct
MGSWYAFKDYLADIKGWLEALGGSEAELAFFEIFIARFELELQAYKGKGNPEVEALRKEAAAIRDELQAYRHN

SEQ ID NO: 1021 - protein, 73 aa, Artificial sequence
  artificial construct
MGSWAEFKQRLAAIKTRLEALGGSEAELAAFEKEIAAFESELQAYKGKGNPEVEALRKEAAAIRDELQAYRHN

SEQ ID NO: 1022-1029 - skipped (8 entries)

SEQ ID NO: 1030 - protein, 73 aa, Artificial sequence
  artificial construct
MGSWEEFELRLNAIEERLYALGGSEAELAYFEYVIADFEGNLQRYKGKGNPEVEALYFEADAIFEELVAYRHN

SEQ ID NO: 1031 - protein, 73 aa, Artificial sequence
  artificial construct
MGSWFEFNHRLWAIFERLMALGGSEAELAAFEKEIAAFESELQAYKGKGNPEVEYLRAMAAVIRYHLQAYRHN

SEQ ID NO: 1032 - protein, 73 aa, Artificial sequence
  artificial construct
MGSWEEFDGRLFAIEQRLQALGGSEAELAAFEKEIAAFESELQAYKGKGNPEVEVLRWFAAGIRDFLQAYRHN

SEQ ID NO: 1033 - protein, 73 aa, Artificial sequence
  artificial construct
MGSWAEFYHRLYAIETRLSALGGSEAELAAFEKEIAAFESELQAYKGKGNPEVEYLRHWAAWIRTYLQAYRHN

SEQ ID NO: 1034 - protein, 73 aa, Artificial sequence
  artificial construct
MGSWVEFSDRLYAIEERLWALGGSEAELAAFEKEIAAFESELQAYKGKGNPEVEELRELAAIIRHSLQAYRHN

SEQ ID NO: 1035 - protein, 73 aa, Artificial sequence
  artificial construct
MGSWWEFEGRLYAIEERLTALGGSEAELAAFEKEIAAFESELQAYKGKGNPEVEYLREWAAWIRQMLQAYRHN

SEQ ID NO: 1036 - protein, 73 aa, Artificial sequence
  artificial construct
MGSWWEFEHRLYAIEERLVALGGSEAELAAFEKEIAAFESELQAYKGKGNPEVEYLRNWAAYIRMALQAYRHN

SEQ ID NO: 1037 - protein, 73 aa, Artificial sequence
  artificial construct
MGSWWEFEARLYAIEFRLSALGGSEAELAAFEKEIAAFESELQAYKGKGNPEVEYLRSWAAYIRTSLQAYRHN

SEQ ID NO: 1038 - protein, 73 aa, Artificial sequence
  artificial construct
MGSWWEFEARLWAIESRLKALGGSEAELAAFEKEIAAFESELQAYKGKGNPEVEYLRHWAAYIRVILQAYRHN

SEQ ID NO: 1039 - protein, 73 aa, Artificial sequence; identical to SEQ ID NO: 1037
  artificial construct

SEQ ID NO: 1040 - protein, 73 aa, Artificial sequence
  artificial construct
MGSWEEFYHRLDAIELRLYALGGSEAELAAFEKEIAAFESELQAYKGKGNPEVEYLRWYAAEIREILQAYRHN

SEQ ID NO: 1041 - protein, 73 aa, Artificial sequence
  artificial construct
MGSWYEFYERLDAIDTRLWALGGSEAELAAFEKEIAAFESELQAYKGKGNPEVEFLREYAAEIRHFLQAYRHN

SEQ ID NO: 1042 - protein, 73 aa, Artificial sequence
  artificial construct
MGSWNEFFDRLDAILYRLDALGGSEAELAAFEKEIAAFESELQAYKGKGNPEVEYLRFVAADIRSWLQAYRHN

SEQ ID NO: 1043 - protein, 73 aa, Artificial sequence
  artificial construct
MGSWIEFDDRLLAIMDRLWALGGSEAELAAFEKEIAAFESELQAYKGKGNPEVEDLRDVAADIRHYLQAYRHN

SEQ ID NO: 1044 - protein, 73 aa, Artificial sequence
  artificial construct
MGSWYEFWERLDAITFRLYALGGSEAELAAFEKEIAAFESELQAYKGKGNPEVEDLRTWAADIRAILQAYRHN

SEQ ID NO: 1045 - protein, 73 aa, Artificial sequence
  artificial construct
MGSWEEFYIRLDAIMERLWALGGSEAELAAFEKEIAAFESELQAYKGKGNPEVEDLRYAAADIRHFLQAYRHN

SEQ ID NO: 1046 - protein, 73 aa, Artificial sequence
  artificial construct
MGSWIEFEERLYAIETRLLALGGSEAELAAFEKEIAAFESELQAYKGKGNPEVEFLRVVAADIREWLQAYRHN

SEQ ID NO: 1047 - protein, 73 aa, Artificial sequence
  artificial construct
MGSWIEFEHRLSAINDRLYALGGSEAELAAFEKEIAAFESELQAYKGKGNPEVEDLREWAADIRSLLQAYRHN

SEQ ID NO: 1048 - protein, 73 aa, Artificial sequence
  artificial construct
MGSWFEFEMRLDAIMARLWALGGSEAELAAFEKEIAAFESELQAYKGKGNPEVEDLRYAAADIRDYLQAYRHN

SEQ ID NO: 1049 - protein, 73 aa, Artificial sequence
  artificial construct
MGSWYEFVYRLDAIYDRLWALGGSEAELAAFEKEIAAFESELQAYKGKGNPEVEDLRYAAADIRDFLQAYRHN

SEQ ID NO: 1050 - protein, 73 aa, Artificial sequence
  artificial construct
MGSWVEFEDRLDAILERLWALGGSEAELAAFEKEIAAFESELQAYKGKGNPEVEDLRELAADIRDFLQAYRHN

SEQ ID NO: 1051 - protein, 73 aa, Artificial sequence
  artificial construct
MGSWFEFEERLIAIEERLFALGGSEAELAAFEKEIAAFESELQAYKGKGNPEVEYLRWIAADIRDVLQAYRHN

SEQ ID NO: 1052 - protein, 73 aa, Artificial sequence
  artificial construct
MGSWIEFADRLDAILDRLDALGGSEAELAAFEKEIAAFESELQAYKGKGNPEVEWLREIAADIRAYLQAYRHN

SEQ ID NO: 1053 - protein, 73 aa, Artificial sequence
  artificial construct
MGSWLEFEYRLDAILDRLFALGGSEAELAAFEKEIAAFESELQAYKGKGNPEVEDLREVAADIRMLLQAYRHN

SEQ ID NO: 1054 - protein, 73 aa, Artificial sequence
  artificial construct
MGSWYEFHDRLDAITNRLYALGGSEAELAAFEKEIAAFESELQAYKGKGNPEVEDLRDWAADIRVWLQAYRHN

SEQ ID NO: 1055 - protein, 73 aa, Artificial sequence
  artificial construct
MGSWQEFEQRLDAINWRLWALGGSEAELAAFEKEIAAFESELQAYKGKGNPEVEELREWAADIRIFLQAYRHN

SEQ ID NO: 1056 - protein, 73 aa, Artificial sequence
  artificial construct
MGSWYEFYSRLDAIDSRLYALGGSEAELAAFEKEIAAFESELQAYKGKGNPEVEFLRDYAAEIRRYLQAYRHN

SEQ ID NO: 1057 - protein, 73 aa, Artificial sequence
  artificial construct
MGSWEEFHDRLEAISDRLWALGGSEAELAAFEKEIAAFESELQAYKGKGNPEVEDLRDWAADIRFYLQAYRHN

SEQ ID NO: 1058 - protein, 73 aa, Artificial sequence
  artificial construct
MGSWWEFDERLYAIEDRLFALGGSEAELAAFEKEIAAFESELQAYKGKGNPEVEWLRIVAADIREILQAYRHN

SEQ ID NO: 1059 - protein, 73 aa, Artificial sequence
  artificial construct
MGSWEEFEYRLMAIEVRLWALGGSEAELAAFEKEIAAFESELQAYKGKGNPEVEVLREIAADIRQILQAYRHN

SEQ ID NO: 1060 - protein, 73 aa, Artificial sequence
  artificial construct
MGSWVVFKQRLAYIKDLLEALGGSEAELAYFEMSIAFFEEDLQVYKGKGNPEVEALRKEAAAIRDELQAYRHN

SEQ ID NO: 1061 - protein, 73 aa, Artificial sequence
  artificial construct
MGSWYEFKNDLAWIKVHLEALGGSEAELAYFEFRIAHFENALQYYKGKGNPEVEALRKEAAAIRDELQAYRHN

SEQ ID NO: 1062 - protein, 73 aa, Artificial sequence
  artificial construct
MGSWVEFYNRLWAIDHRLHALGGSEAELAAFEKEIAAFESELQAYKGKGNPEVEVLRYHAASIRVTLQAYRHN

SEQ ID NO: 1063 - protein, 73 aa, Artificial sequence
  artificial construct
MGSWSEFYDRLHAIHHRLYALGGSEAELAAFEKEIAAFESELQAYKGKGNPEVEALRDTAAFIRTRLQAYRHN

SEQ ID NO: 1064 - protein, 73 aa, Artificial sequence
  artificial construct
MGSWKEFHFRLHAIEHRLIALGGSEAELAAFEKEIAAFESELQAYKGKGNPEVEFLRAKAANIRTHLQAYRHN

SEQ ID NO: 1065 - protein, 73 aa, Artificial sequence
  artificial construct
MGSWFEFHGRLHAIYGRLSALGGSEAELAAFEKEIAAFESELQAYKGKGNPEVEHLRAHAAHIRDHLQAYRHN

SEQ ID NO: 1066 - protein, 73 aa, Artificial sequence
  artificial construct
MGSWYEFADRLHAIHQRLYALGGSEAELAAFEKEIAAFESELQAYKGKGNPEVEALRMTAAFIRSRLQAYRHN

SEQ ID NO: 1067 - protein, 73 aa, Artificial sequence
  artificial construct
MGSWNEFYNRLHAIHQRLYALGGSEAELAAFEKEIAAFESELQAYKGKGNPEVESLRQTAAYIRDRLQAYRHN

SEQ ID NO: 1068 - protein, 73 aa, Artificial sequence
  artificial construct
MGSWNEFADRLHAIHQRLYALGGSEAELAAFEKEIAAFESELQAYKGKGNPEVESLRMTAAFIRSRLQAYRHN

SEQ ID NO: 1069 - protein, 73 aa, Artificial sequence
  artificial construct
MGSWTEFSYRLGAIQSRLHALGGSEAELAAFEKEIAAFESELQAYKGKGNPEVEHLRYNAAKIRHFLQAYRHN

SEQ ID NO: 1070 - protein, 73 aa, Artificial sequence
  artificial construct
MGSWQEFTTRLEAIYHRLRALGGSEAELANFEGFIAEFEGNLQMYKGKGNPEVEALVHEAYAIMEELHAYRHN

SEQ ID NO: 1071 - protein, 73 aa, Artificial sequence
  artificial construct
MGSWVEFFDRLKAIHDRLEALGGSEAELAHFEKLIAHFEHRLQNYKGKGNPEVEALEKEADAILYELAAYRHN

SEQ ID NO: 1072 - protein, 73 aa, Artificial sequence
  artificial construct
MGSWYYFKHHLAWIKMELEALGGSEAELAHFESSIASFERDLQQYKGKGNPEVEALRKEAAAIRDELQAYRHN

SEQ ID NO: 1073 - protein, 73 aa, Artificial sequence
  artificial construct
MGSWVEFHIRLHAIQYRLYALGGSEAELAAFEKEIAAFESELQAYKGKGNPEVEELRHWAAFIRLQLQAYRHN

SEQ ID NO: 1074 - protein, 73 aa, Artificial sequence
  artificial construct
MGSWNEFHDRLNAIHARLHALGGSEAELAAFEKEIAAFESELQAYKGKGNPEVENLRDDAAFIRRFLQAYRHN

SEQ ID NO: 1075 - protein, 73 aa, Artificial sequence
  artificial construct
MGSWYEFTVRLEAIHERLKALGGSEAELAAFEKEIAAFESELQAYKGKGNPEVEILRDDAAFIRRFLQAYRHN

SEQ ID NO: 1076 - protein, 73 aa, Artificial sequence
  artificial construct
MGSWKEFDDRLNAIKARLQALGGSEAELAAFEKEIAAFESELQAYKGKGNPEVEDLRDDAAFIRRFLQAYRHN

SEQ ID NO: 1077 - protein, 73 aa, Artificial sequence
  artificial construct
MGSWYEFDDRLNAIHDRLQALGGSEAELAAFEKEIAAFESELQAYKGKGNPEVEDLRDDAAFIRRFLQAYRHN

SEQ ID NO: 1078 - protein, 73 aa, Artificial sequence
  artificial construct
MGSWNEFKNRLDAIHKRLNALGGSEAELAAFEKEIAAFESELQAYKGKGNPEVENLRDDAAFIRHFLQAYRHN

SEQ ID NO: 1079 - protein, 73 aa, Artificial sequence
  artificial construct
MGSWTEFEQRLEAIHNRLQALGGSEAELAAFEKEIAAFESELQAYKGKGNPEVEELRNDAAFIRHFLQAYRHN

SEQ ID NO: 1080 - skipped

SEQ ID NO: 1081 - protein, 163 aa, Homo sapiens
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 1082 - protein, 170 aa, Artificial sequence
  artificial construct
DEMGSWDEFGRRLYAIEWRLYALGGSEAELAAFEKEIAAFESELQAYKGKGNPEVEKLREIAAVIRSNLQAYRHNGGGGSGGGGSGGGGSGMLQMAGQCSQNEYFDSLLHACIPCQLRCSSNTPPLTCQRYCNASVTNSVKGTNAGGGGSGGGGSGGGGSHHHHHHHHHH

SEQ ID NO: 1083 - protein, 175 aa, Artificial sequence
  artificial construct
DEGGGGSMGSWAEFKQRLAAIKTRLQALGGSEAELAAFEKEIAAFESELQAYKGKGNPEVEALRKEAAAIRDELQAYRHNGGGGSGGGGSGGGGSGMLQMAGQCSQNEYFDSLLHACIPCQLRCSSNTPPLTCQRYCNASVTNSVKGTNAGGGGSGGGGSGGGGSHHHHHHHHHH

SEQ ID NO: 1084 - protein, 343 aa, Artificial sequence
  artificial construct
DEHHHHHHHHHHKLENLYFQGGGGGSMGSWDEFGRRLYAIEWRLYALGGSEAELAAFEKEIAAFESELQAYKGKGNPEVEKLREIAAVIRSNLQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1085 - protein, 343 aa, Artificial sequence
  artificial construct
DEHHHHHHHHHHKLENLYFQGGGGGSMGSWSEFWVRLGAIRERLDALGGSEAELAAFEKEIAAFESELQAYKGKGNPEVEKLRYTAATIRRFLQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1086 - protein, 343 aa, Artificial sequence
  artificial construct
DEHHHHHHHHHHKLENLYFQGGGGGSMGSWAEFKQRLAAIKTRLEALGGSEAELAAFEKEIAAFESELQAYKGKGNPEVEALRKEAAAIRDELQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1087 - protein, 438 aa, Artificial sequence
  artificial construct
DEGGGGSMGSWDEFGRRLYAIEWQLYALGGTEAELAAFEKEIAAFESELQAYKGKGNPEVEKLREIAAVIRENLQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWDEFGRRLYAIEWQLYALGGTEAELAAFEKEIAAFESELQAYKGKGNPEVEKLREIAAVIRENLQAYRHNGGGGSGGGGSGGGGSHHHHHHHHHH

SEQ ID NO: 1088 - protein, 438 aa, Artificial sequence
  artificial construct
DEGGGGSMGSWSEFWVRLGAIRERLDALGGSEAELAAFEKEIAAFESELQAYKGKGNPEVEKLRYTAATIRRFLQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWSEFWVRLGAIRERLDALGGSEAELAAFEKEIAAFESELQAYKGKGNPEVEKLRYTAATIRRFLQAYRHNGGGGSGGGGSGGGGSHHHHHHHHHH

SEQ ID NO: 1089 - protein, 338 aa, Artificial sequence
  artificial construct
MAFLWLLSCWALLGTTFGDYKDDDDKGGGGSGGGGSMGSWAEFKQRLAAIKTRLEALGGSEAELAAFEKEIAAFESELQAYKGKGNPEVEALRKEAAAIRDELQAYRHNGQAGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1090 - protein, 343 aa, Artificial sequence
  artificial construct
MAFLWLLSCWALLGTTFGDYKDDDDKGGGGSGGGGSMGSWDEFGRRLYAIEWRLYALGGSEAELAAFEKEIAAFESELQAYKGKGNPEVEKLREIAAVIRSNLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1091 - protein, 343 aa, Artificial sequence
  artificial construct
MAFLWLLSCWALLGTTFGDYKDDDDKGGGGSGGGGSMGSWSEFWVRLGAIRERLDALGGSEAELAAFEKEIAAFESELQAYKGKGNPEVEKLRYTAATIRRFLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1092 - protein, 343 aa, Artificial sequence
  artificial construct
MAFLWLLSCWALLGTTFGDYKDDDDKGGGGSGGGGSMGSWFEFYDRLNAIDARLWALGGSEAELAAFEKEIAAFESELQAYKGKGNPEVENLRVHAAAIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1093 - protein, 343 aa, Artificial sequence
  artificial construct
MAFLWLLSCWALLGTTFGDYKDDDDKGGGGSGGGGSMGSWLEFYHRLNAIDSRLWALGGSEAELAAFEKEIAAFESELQAYKGKGNPEVESLRDHAAHIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1094-1098 - skipped (5 entries)

SEQ ID NO: 1099 - protein, 5 aa, Artificial sequence
  artificial construct
GGGGG

SEQ ID NO: 1100 - protein, 8 aa, Artificial sequence
  artificial construct
GGGGGGGG

SEQ ID NO: 1101 - protein, 25 aa, Homo sapiens
MTMYLWLKLLAFGFAFLDTEVFVTG

SEQ ID NO: 1102 - protein, 1306 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1103 - protein, 1145 aa, Homo sapiens
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1104 - protein, 1310 aa, Macaca mulatta
MTMCLWLKLLAFVFAFLDTEVFVTGQGSTLSPTGRRTTKMPSVPLSSDPLPTHTTAFSPASISERENDFSETTPSLSSDNTSTHVSPDSLDNASAFNTTGVSSALTPHLPTHADSQTPSTGTDTQTPSGSAANTTLSPTPRSNDISDVPGERSTASTFPTDPISPLATTLIPARNSSAALPARTSNTTITANTSVSYLNASETTTPSPSGSTVISTPTIATTTSKPTCAEKYATIPVDYLYNNKTKLFTAKLNVNENVECTNNNHTHNICTNNEVLNLPECKEMNVFVSHNSCTDRHKELKLDVPPEVEKFQLDDCTPDVEANTTICLKWKIIETFACDKSKITYRFQCGNKTYNKEGIYLENLEPEYEYKCDSEILYNNHKYINITKLIKTDFGIPGQPQNVVCRHEDAHQGVITWNPPQRSFHNFTLCYVSKTAKKCLSLDKHLTTYHLQNLKPYTNYSLSLHAYIIAKVQRNGTAATCNFTTESAPPSQVQNMIVSTSDNSMRVKCEGPRDVNGPTGLYHLEVEAGNTLVRNLSQSKCDFSVNNLQYSTYYNLKAYYHNGKYSGEPVILRESTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKNKNRNSNVIPYDYNRVPLKHELEMSKESDHDSDESSDDDSDSEEPSKYINASFIMSYWKPEVMIAAQGPLKETIGDFWQMIFQRKVKVIVMLTELKHGDQEICAQYWGEGKQTYGDIEVDMKDTNKSSTYTLRVFELRHSKRKDSRTVYQYQYTNWSVEQLPAEPKELVSLIQVLKEKLPQKNSSEGNKHHKSTPLLIHCRDGSQQTGIFCALLNLLESAETEEVVDIFQVVKALRKARPGMVSTFEQYQFLYDIIASTYPAQNGQVKKNNHQEDKIEFDNEVDKVKQDANCVNPLGATEKLPEAKEQATGSEPTSGTEGPEHSVNGPASPALNQGS

SEQ ID NO: 1105 - protein, 1310 aa, Macaca fascicularis
MTMCLWLKLLAFVFAFLDTEVFVTGQGSTLSPTGRRTTKMPSVPLSSDPLPTHTTAFSPASISERENDFSETTPSLSSDNTSTQVSPDSLDNASAFNTTGVSSALTPHLPTHADSQTPSTGTDTQTPSGSAANTTLSPTPRSNDISDVPGERSTASTFPTDPISPLATTLIPARNSSAALPARTSNTTITANTSVSYLNASETTTPSPSGSTVISTPTIATTTSKPTCAEKYATIPVDYLYNNKTKLFTAKLNVNENVECTNNNHTHNICTNNEVLNLPECKEMNVFVSHNSCTDRHKELKLDVPPEVEKFQLDDCTPDVEANTTICLKWKIIETFACDKSKITYRFQCGNKTYNKEGIYLENLEPEYEYKCDSEILYNNHKYINITKLIKTDFGIPGQPQNVVCRHEDAHQGVITWNPPQRSFHNFTLCYVNKPAKKCLILDKHLTTYHLQNLKPYTNYSLSLHAYIIAKVQRNGTAATCNFTTESAPPSQVQNMIVSTSDNSMHVKCEVPRDVNGPTGLYHLEVEAGNTLVRNLSQSKCDFSVNNLQYSTYYNLKAYYHNGKYSGEPVILRESTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDIVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKNKNRNSNVIPYDYNRVPLKHELEMSKESDHDSDESSDDDSDSEEPSKYINASFIMSYWKPEVMIAAQGPLKETIGDFWQMIFQRKVKVIVMLTELKHGDQEICAQYWGEGKQTYGDIEVDMKDTNKSSTYTLRVFELRHSKRKDSRTVYQYQYTNWSVEQLPAEPKELVSLIQVLKEKLPQKNFSEGNKHHKSTPLLIHCRDGSQQTGIFCALLNLLESAETEEVVDIFQVVKALRKARPGMVSTFEQYQFLYDIIASTYPAQNGQVKKNNHQEDKIEFDNEVDKVKQDANCVNPLGATEKLPEAKEQATGSEPTSGTEGPEHSVNGPASPALNQGS

SEQ ID NO: 1106 - protein, 552 aa, Homo sapiens
QSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1107 - protein, 391 aa, Homo sapiens
QSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1108 - protein, 457 aa, Homo sapiens
QSPTPSPTGLTTAKMPSVPLSSDPLPTHTTAFSPASTFERENDFSETTTSLSPDNTSTQVSPDSLDNASAFNTTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1109 - protein, 438 aa, Homo sapiens
QSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1110 - protein, 504 aa, Homo sapiens
QSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1111 - protein, 505 aa, Homo sapiens
QSPTPSPTGLTTAKMPSVPLSSDPLPTHTTAFSPASTFERENDFSETTTSLSPDNTSTQVSPDSLDNASAFNTTDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1112 - protein, 486 aa, Homo sapiens
QSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 1113 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1114 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 1115 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 1116 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 1117 - protein, 229 aa, Artificial sequence
  artificial construct
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 1118 - protein, 204 aa, Artificial sequence
  artificial construct
QESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1119 - protein, 204 aa, Artificial sequence
  artificial construct
QESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 1120 - protein, 207 aa, Artificial sequence
  artificial construct
KYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1121 - protein, 207 aa, Artificial sequence
  artificial construct
KYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 1122 - protein, 213 aa, Artificial sequence
  artificial construct
GEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1123 - protein, 213 aa, Artificial sequence
  artificial construct
GEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 1124 - protein, 350 aa, Artificial sequence
  artificial construct
DEGGGGSMGSWSEFWARLGAIRERLDALGGSEAELAAFEKEIAAFESELQAYKGKGNPEVEKLRYTAGTIKRFLQAYRHNGGGGDGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSHHHHHHHHHH

SEQ ID NO: 1125 - protein, 345 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSHHHHHHHHHH

SEQ ID NO: 1126 - protein, 320 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSHHHHHHHHHH

SEQ ID NO: 1127 - protein, 323 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSHHHHHHHHHH

SEQ ID NO: 1128 - protein, 329 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSHHHHHHHHHH

SEQ ID NO: 1129 - protein, 438 aa, Artificial sequence
  artificial construct
DEGGGGSMGSWSEFWARLGAIRERLDALGGSEAELAAFEKEIAAFESELQAYKGKGNPEVEKLRYTAGTIKRFLQAYRHNGGGGDGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWSEFWARLGAIRERLDALGGSEAELAAFEKEIAAFESELQAYKGKGNPEVEKLRYTAGTIKRFLQAYRHNGGGGDGGGGSGGGGSHHHHHHHHHH

SEQ ID NO: 1130 - protein, 408 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGVGGGGSGGGGSGGGGSMGSWSEFWARLGAIRERLDALGGSEAELAAFEKEIAAFESELQAYKGKGNPEVEKLRYTAGTIKRFLQAYRHNGGGGSGGGGSGGGGSHHHHHHHHHH

SEQ ID NO: 1131 - protein, 320 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGVGGGGSGGGGSGGGGSHHHHHHHHHH

SEQ ID NO: 1132 - protein, 408 aa, Artificial sequence
  artificial construct
DEMGSWSEFWARLGAIRERLDALGGSEAELAAFEKEIAAFESELQAYKGKGNPEVEKLRYTAGTIKRFLQAYRHNGGGGDGGGGSGGGGSGQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWSEFWARLGAIRERLDALGGSEAELAAFEKEIAAFESELQAYKGKGNPEVEKLRYTAGTIKRFLQAYRHNGGGGSGGGGSGGGGSHHHHHHHHHH

SEQ ID NO: 1133 - protein, 343 aa, Artificial sequence
  artificial construct
MAFLWLLSCWALLGTTFGDYKDDDDKGGGGSGGGGSMGSWFEFYDRLNAIDARLWALGGSEAELAAFEKEIAAFESELQAYKGKGNPEVESLRVHAAAIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1134 - protein, 343 aa, Artificial sequence
  artificial construct
MAFLWLLSCWALLGTTFGDYKDDDDKGGGGSGGGGSMGSWSEFYDRLNAIDARLWALGGSEAELAAFEKEIAAFESELQAYKGKGNPEVESLRVHAAAIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1135 - protein, 343 aa, Artificial sequence
  artificial construct
MAFLWLLSCWALLGTTFGDYKDDDDKGGGGSGGGGSMGSWFEFYDRLNAIDARLWALGGSEAELAAFEKEIAAFESELQAYKGKGNPEVESLREHAAAIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1136 - protein, 343 aa, Artificial sequence [sequence omitted]

SEQ ID NO: 1137 - protein, 22 aa, Homo sapiens
MAGSPTCLTLIYILWQLTGSAA

SEQ ID NO: 1138 - protein, 226 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 1139 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 1140 - protein, 5 aa, Artificial Sequence
  artificial construct
  misc_feature (1)..(5): Xaa can be any naturally occurring amino acid
XXXXX

SEQ ID NO: 1141 - protein, 491 aa, Artificial sequence
  artificial construct
QVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1142 - protein, 491 aa, Artificial sequence
  artificial construct
DIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 1143 - protein, 491 aa, Artificial sequence
  artificial construct
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIK

SEQ ID NO: 1144 - protein, 491 aa, Artificial sequence
  artificial construct
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVS

SEQ ID NO: 1145 - protein, 753 aa, Artificial sequence
  artificial construct
DIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVS

SEQ ID NO: 1146 - protein, 753 aa, Artificial sequence
  artificial construct
QVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIK

SEQ ID NO: 1147 - protein, 753 aa, Artificial sequence
  artificial construct
DIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIK

SEQ ID NO: 1148 - protein, 753 aa, Artificial sequence
  artificial construct
QVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGGSGGGGSAGGGSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSAGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVS

SEQ ID NO: 1149 - protein, 5 aa, Artificial sequence
  artificial construct
  misc_feature (1)..(5): Xaa can be any naturally occurring amino acid
XXXXX

SEQ ID NO: 1150 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWVEFNERLHAIYLRLDALGGSEAELAAFEKEIAAFESELQAYKGKGNPEVETLRRHAAGIRWQLQAYRHNGGGGSGGGGSGGGGSHHHHHHHHHH

SEQ ID NO: 1151 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWVEFEARLSAIYERLEALGGSEAELAAFEKEIAAFESELQAYKGKGNPEVEKLRRHAAGIRSNLQAYRHNGGGGSGGGGSGGGGSHHHHHHHHHH

SEQ ID NO: 1152 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWVEFFVRLDAIWERLEALGGSEAELAAFEKEIAAFESELQAYKGKGNPEVETLRFHAAGIRQKLQAYRHNGGGGSGGGGSGGGGSHHHHHHHHHH

SEQ ID NO: 1153 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWNEFKLELAFIKDWLEALGGSEAELANFEEAIAEFEAGLQGYKGKGNPEVEALRKEAAAIRDELQAYRHNGGGGSGGGGSGGGGSHHHHHHHHHH

SEQ ID NO: 1154 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWMEFEARLEAIWDRLEALGGSEAELAAFEKEIAAFESELQAYKGKGNPEVESLRFHAAGIRQHLQAYRHNGGGGSGGGGSGGGGSHHHHHHHHHH

SEQ ID NO: 1155 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWHHFKMHLAGIKLQLEALGGSEAELAEFEEWIADFEGALQDYKGKGNPEVEALRKEAAAIRDELQAYRHNGGGGSGGGGSGGGGSHHHHHHHHHH

SEQ ID NO: 1156 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWAEFKQRLAAIKTRLEALGGSEAELAAFEKEIAAFESELQAYKGKGNPEVEALRKEAAAIRDELQAYRHNGGGGSGGGGSGGGGSHHHHHHHHHH

SEQ ID NO: 1157 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWAEFRWRLHAIWLQLGALGGSEAELAAFEKEIAAFESELQAYKGKGNPEVEWLRQDAAQIKYILQAYRHNGGGGSGGGGSGGGGSHHHHHHHHHH

SEQ ID NO: 1158 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWKTFKIELAGIKLELEALGGSEAELAGFENAIAQFESSLQYYKGKGNPEVEALRKEAAAIRDELQAYRHNGGGGSGGGGSGGGGSHHHHHHHHHH

SEQ ID NO: 1159 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWHEFLRRLLAIEMRLYALGGSEAELAAFEKEIAAFESELQAYKGKGNPEVEHLRVRAASIRQMLQAYRHNGGGGSGGGGSGGGGSHHHHHHHHHH

SEQ ID NO: 1160 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWWEFRVRLEAIDYRLKALGGSEAELAAFEKEIAAFESELQAYKGKGNPEVEYLRMKAATIRAILQAYRHNGGGGSGGGGSGGGGSHHHHHHHHHH

SEQ ID NO: 1161 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWYEFRWRLHAIWLRLGALGGSEAELAAFEKEIAAFESELQAYKGKGNPEVEWLRQDAAQIRYILQAYRHNGGGGSGGGGSGGGGSHHHHHHHHHH

SEQ ID NO: 1162 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWWEFNIRLHAIDYRLKALGGSEAELAAFEKEIAAFESELQAYKGKGNPEVELLREKAAQIRAQLQAYRHNGGGGSGGGGSGGGGSHHHHHHHHHH

SEQ ID NO: 1163 - protein, 432 aa, Artificial sequence
  artificial construct
MGSWAEFKQRLAAIKTRLEALGGSEAELAAFEKEIAAFESELQAYKGKGNPEVEALRKEAAAIRDELQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSGMGSWWEFNMRLSAIKYRLYALGGSEAELAAFEKEIAAFESELQAYKGKGNPEVEILRRLAADIRERLQAYRHNGGGGSGGGGSGGGGSHHHHHHHHHH

What is claimed is:

1. A protein comprising a D domain that specifically binds an AFP P26 polypeptide, wherein the AFP P26 polypeptide comprises the amino acid sequence of SEQ ID NO: 16, 1117, 1118, 1119, 1120, 1121, 1122, or 1123, and the D domain comprises the amino acid sequence of SEQ ID NO: 842, 843, 844, 848, 850 or 863.

2. The protein of claim 1 wherein the D domain is fused to a heterologous polypeptide.

3. A chimeric antigen receptor (CAR) which comprises a target binding domain comprising the protein of claim 1, a transmembrane domain, and an intracellular signaling domain.

4. An isolated nucleic acid encoding the protein of claim 1.

5. A host cell comprising the nucleic acid of claim 4.

6. The host cell of claim 5, wherein the cell is an immune effector cell.

7. The protein of claim 1, wherein the D domain comprises the amino acid sequence of SEQ ID NO: 848.

8. The protein of claim 1, wherein the D domain comprises the amino acid sequence of SEQ ID NO: 850.

9. The protein of claim 1, wherein the D domain comprises the amino acid sequence of SEQ ID NO: 863.

10. The CAR of claim 3, wherein the D domain comprises the amino acid sequence of SEQ ID NO: 848.

11. The CAR of claim 3, wherein the D domain comprises the amino acid sequence of SEQ ID NO: 850.

12. The CAR of claim 3, wherein the D domain comprises the amino acid sequence of SEQ ID NO: 863.

13. The CAR of claim 3, wherein transmembrane domain comprises a CD8, 41BB or CD28 transmembrane domain.

14. The CAR of claim 3, wherein the intracellular signaling domain is selected from the group consisting of a domain of a human T cell receptor alpha, beta, or zeta chain; a human 41BB domain; a human CD28 domain; and any combination thereof.

15. The CAR of claim 3, wherein the intracellular signaling domain comprises the intracellular domain of a costimulatory molecule selected from the group consisting of CD27, CD28, 41BB, OX40, CD30, CD40, PD1, lymphocyte function-associated antigen-1 (LFA-1), CD2, CD7, LIGHT, NKG2C, NKG2D, B7-H3, a ligand that specifically binds with CD83, and any combination thereof.

16. The CAR of claim 3, wherein transmembrane domain comprises a CD8 transmembrane domain and the intracellular signaling domain comprises a human 41BB domain and a human CD3 zeta domain.

17. The CAR of claim 3, wherein transmembrane domain and the intracellular signaling domain comprises the amino acid sequence of residues 121-343 of SEQ ID NO: 1136.

18. The CAR of claim 17, wherein the D domain comprises the amino acid sequence of SEQ ID NO: 848.

19. The CAR of claim 17, wherein the D domain comprises the amino acid sequence of SEQ ID NO: 850.

20. The CAR of claim 17, wherein the D domain comprises the amino acid sequence of SEQ ID NO: 863.

21. An isolated nucleic acid encoding the CAR of claim 3.

22. An isolated nucleic acid encoding the CAR of claim 16.

23. An isolated nucleic acid encoding the CAR of claim 17.

24. An isolated nucleic acid encoding the CAR of claim 18.

25. An isolated nucleic acid encoding the CAR of claim 19.

26. An isolated nucleic acid encoding the CAR of claim 20.

27. A vector comprising the nucleic add of claim 21.

28. A vector comprising the nucleic acid of claim 22.

29. A vector comprising the nucleic acid of claim 23.

30. A vector comprising the nucleic acid of claim 24.
31. A vector comprising the nucleic acid of claim 25.
32. A vector comprising the nucleic acid of claim 26.
33. The vector of claim 27 which is a lentiviral vector.
34. The vector of claim 28 which is a lentiviral vector.
35. The vector of claim 29 which is a lentiviral vector.
36. The vector of claim 30 which is a lentiviral vector.
37. The vector of claim 31 which is a lentiviral vector.
38. The vector of claim 32 which is a lentiviral vector.
39. A host cell comprising the nucleic acid of claim 21.
40. A host cell comprising the nucleic acid of claim 22.
41. A host cell comprising the nucleic acid of claim 23.
42. A host cell comprising the nucleic acid of claim 24.
43. A host cell comprising the nucleic acid of claim 25.
44. A host cell comprising the nucleic acid of claim 26.
45. A host cell comprising the vector of claim 27.
46. Host cell comprising the vector of claim 28.
47. A host cell comprising the vector of claim 29.
48. A host cell comprising the vector of claim 30.
49. A host cell comprising the vector of claim 31.
50. A host cell comprising the vector of claim 32.
51. A host cell engineered to express the CAR of claim 3.
52. A host cell engineered to express the CAR of claim 16.
53. A host cell engineered to express the CAR of claim 17.
54. A host cell engineered to express the CAR of claim 18.
55. A host cell engineered to express the CAR of claim 19.
56. A host cell engineered to express the CAR of claim 20.
57. The host cell of claim 51, wherein the cell is an immune effector cell.
58. The host cell of claim 52, wherein the cell is an immune effector cell.
59. The host cell of claim 53, wherein the cell is an immune effector cell.
60. The host cell of claim 54, wherein the cell is an immune effector cell.
61. The host cell of claim 55, wherein the cell is an immune effector cell.
62. The host cell of claim 56, wherein the cell is an immune effector cell.
63. The host cell of claim 57, wherein the immune effector cell is a T cell or NK cell.
64. The host cell of claim 58, wherein the immune effector cell is a T cell or NK cell.
65. The host cell of claim 59, wherein the immune effector cell is a T cell or NK cell.
66. The host cell of claim 60, wherein the immune effector cell is a T cell or NK cell.
67. The host cell of claim 61, wherein the immune effector cell is a T cell or NK cell.
68. The host cell of claim 62, wherein the immune effector cell is a T cell or NK cell.

* * * * *

UNITED STATES PATENT AND TRADEMARK OFFICE
CERTIFICATE OF CORRECTION

PATENT NO. : 11,730,763 B2  
APPLICATION NO. : 16/763776  
DATED : August 22, 2023  
INVENTOR(S) : David M. Hilbert, Jeffrey S. Swers and David William Lafleur Page 1 of 3

It is certified that error appears in the above-identified patent and that said Letters Patent is hereby corrected as shown below:

In the Specification

Column 55, Lines 13-14, please replace "SEQ ID NO: 1119" with -- SEQ ID NO: 1137 --.

Column 55, Line 15, please replace "SEQ ID NO: 1120" with -- SEQ ID NO: 1138 --.

Column 55, Line 16, please replace "SEQ ID NO: 1121" with -- SEQ ID NO: 1139 --.

Column 68, please replace:

"

| ASBD | Sequence |
|---|---|
| Avimer1 | EFX$_3$CX$_5$NGX$_8$CIPX$_{12}$X$_{13}$WX$_{15}$C DGX$_{19}$DDCGDX$_{25}$SDE (SEQ ID NO: 33) |
| Fynomer1 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEK FQILSTHEYEX$_{41}$X$_{42}$ X$_{43}$X$_{44}$X$_{45}$X$_{46}$X$_{47}$ X$_{48}$WEARSLTTGETGX$_{61}$IPSNY VAPVDSIQ wherein X= any amino acid residue and X$_{13}$-X$_{21}$ and X$_{42}$-X$_{46}$, are optionally absent (SEQ ID NO: 34) |
| Fynomer2 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEKFQILSTHEYEDWWE ARSLTTGETGYIPSNYVAPVDSIQ, wherein X$_{16}$-X$_{21}$ are optionally absent (SEQ ID NO: 35) |
| Kunitz1 | MHSFCAFKADX$_{11}$GXi3CX$_{15}$ X$_{16}$X$_{17}$X$_{18}$X$_{19}$RFFFNIFTRQCEEFX$_{34}$ YGGCX$_{39}$X$_{40}$NQNR FES LEECKK MCTRDGA (SEQ ID NO: 36) |
| WW1 | KLPPGWX$_7$KX$_9$WSX$_{12}$X$_{13}$X$_{14}$GRVX$_{18}$ YX$_{20}$NX$_{22}$ITX$_{25}$AX$_{27}$QWERP (SEQ ID NO: 37) |
| WW2 | KLPPGWX$_7$KX$_9$WSX$_{12}$X$_{13}$GRVX$_{17}$ YX$_{19}$NX$_{21}$ITX$_{24}$AX$_{26}$QWERP (SEQ ID NO: 38) |
| X = all amino acid residues | |

"

Signed and Sealed this  
Fourth Day of June, 2024

*Katherine Kelly Vidal*

Katherine Kelly Vidal  
*Director of the United States Patent and Trademark Office*

With the following table:

| ASBD | Sequence |
|---|---|
| Avimer1 | EFX$_3$CX$_5$NGX$_8$CIPX$_{12}$X$_{13}$WX$_{15}$C DGX$_{19}$DDCGDX$_{25}$SDE (SEQ ID NO: 33) |
| Fynomer1 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEK FQILSTHEYEX$_{41}$X$_{42}$X$_{43}$X$_{44}$X$_{45}$X$_{46}$X$_{47}$ X$_{48}$WEARSLTTGETGX$_{61}$IPSNY VAPVDSIQ wherein X= any amino acid residue and X$_{13}$-X$_{21}$ and X$_{42}$-X$_{46}$, are optionally absent (SEQ ID NO: 34) |
| Fynomer2 | GVTLFVALYDYX$_{12}$X$_{13}$X$_{14}$X$_{15}$X$_{16}$X$_{17}$X$_{18}$X$_{19}$X$_{20}$X$_{21}$X$_{22}$LSFHKGEKFQILS<u>THEYEDWWE</u> ARSLTTGETGYIPSNYVAPVDSIQ, wherein X$_{16}$-X$_{21}$ are optionally absent (SEQ ID NO: 35) |
| Kunitz1 | MHSFCAFKADX$_{11}$GX$_{13}$CX$_{15}$ X$_{16}$X$_{17}$X$_{18}$X$_{19}$RFFFNIFTRQCEEFX$_{34}$ YGGCX$_{39}$X$_{40}$NQNR FES LEECKK MCTRDGA (SEQ ID NO: 36) |
| WW1 | KLPPGWX$_7$KX$_9$WSX$_{12}$X$_{13}$X$_{14}$GRVX$_{18}$ YX$_{20}$NX$_{22}$ITX$_{25}$AX$_{27}$QWERP (SEQ ID NO: 37) |
| WW2 | KLPPGWX$_7$KX$_9$WSX$_{12}$X$_{13}$GRVX$_{17}$ YX$_{19}$NX$_{21}$ITX$_{24}$AX$_{26}$QWERP (SEQ ID NO: 38) |
| X = all amino acid residues | |

Column 292, Line 61, please replace "SEQ ID NO: 1118" with -- SEQ ID NO: 1122 --.

Column 292, Line 66, after "In p26(Q26-V229)" please insert -- (SEQ ID NO: 1118) --.

Column 295, please replace:

| CS1 (SLAMF7, CRACC, CD319) Adapter Constructs | Adapter SEQ ID NO: | CS1 ADBD SEQ ID NO: | CS1 ADBD clone ID |
|---|---|---|---|
| □3D Q19E-p26-cc08.HIS | 1500 | 787 | cc08 |
| □3D Q19E-p26-cc01.HIS | 1501 | 780 | cc01 |
| □3D Q19E-p26-cc02.HIS | 1502 | 781 | cc02 |
| □3D Q19E-p26-cc09.HIS | 1503 | 788 | cc09 |
| □3D Q19E-p26-cc10.HIS | 1504 | 789 | cc10 |
| □3D Q19E-p26-cc12.HIS | 1505 | 791 | cc12 |

With the following table:

| CS1 (SLAMF7, CRACC, CD319) Adapter Constructs | Adapter SEQ ID NO: | CS1 ADBD SEQ ID NO: | CS1 ADBD clone ID |
|---|---|---|---|
| α3D Q19E-p26-cc08.HIS | 1150 | 787 | cc08 |
| α3D Q19E-p26-cc01.HIS | 1151 | 780 | cc01 |
| α3D Q19E-p26-cc02.HIS | 1152 | 781 | cc02 |
| α3D Q19E-p26-cc09.HIS | 1153 | 788 | cc09 |
| α3D Q19E-p26-cc10.HIS | 1154 | 789 | cc10 |
| α3D Q19E-p26-cc12.HIS | 1155 | 791 | cc12 |

Column 296, please replace:

| HER2 (erbB2) Adapter Constructs | Adapter Construct SEQ ID NO: | HER2 ADBD SEQ ID NO: | ADBD clone ID |
|---|---|---|---|
| α3D(Q19E).3xGS.p26.3xGS. α3D(Q19E).HIS | 1506 | N/A | N/A |
| α3D(Q19E).3xGS.p26.3xGS.eb03.HIS | 1507 | 804 | eb03 |
| α3D(Q19E).3xGS.p26.3xGS.eb04.HIS | 1508 | 814 | eb04 |
| α3D(Q19E).3xGS.p26.3xGS.eb05.HIS | 1509 | 810 | eb05 |
| α3D(Q19E).3xGS.p26.3xGS.eb06.HIS | 1510 | 834 | eb06 |
| α3D(Q19E).3xGS.p26.3xGS.eb08.HIS | 1511 | 809 | eb08 |
| α3D(Q19E).3xGS.p26.3xGS.eb09.HIS | 1512 | 833 | eb09 |
| α3D(Q19E).3xGS.p26.3xGS.eb10.HIS | 1513 | 839 | eb10 |

With the following table:

| HER2 (erbB2) Adapter Constructs | Adapter Construct SEQ ID NO: | HER2 ADBD SEQ ID NO: | ADBD clone ID |
|---|---|---|---|
| α3D(Q19E).3xGS.p26.3xGS. α3D(Q19E).HIS | 1156 | N/A | N/A |
| α3D(Q19E).3xGS.p26.3xGS.eb03.HIS | 1157 | 804 | eb03 |
| α3D(Q19E).3xGS.p26.3xGS.eb04.HIS | 1158 | 814 | eb04 |
| α3D(Q19E).3xGS.p26.3xGS.eb05.HIS | 1159 | 810 | eb05 |
| α3D(Q19E).3xGS.p26.3xGS.eb06.HIS | 1160 | 834 | eb06 |
| α3D(Q19E).3xGS.p26.3xGS.eb08.HIS | 1161 | 809 | eb08 |
| α3D(Q19E).3xGS.p26.3xGS.eb09.HIS | 1162 | 833 | eb09 |
| α3D(Q19E).3xGS.p26.3xGS.eb10.HIS | 1163 | 839 | eb10 |